US012570740B2

(12) United States Patent
Wake et al.

(10) Patent No.: US 12,570,740 B2
(45) Date of Patent: Mar. 10, 2026

(54) TREATMENT FOR PHYSIOLOGICAL IRON OVERLOAD WITH AN ANTI-MATRIPTASE-2 ANTIBODY

(71) Applicant: Kymab Limited, Babraham (GB)

(72) Inventors: Matthew Wake, Babraham (GB); Volker Germaschewski, Babraham (GB); Igor Theurl, Babraham (GB); Jonathan Leslie Papworth, Babraham (GB); Delphine Meynard, Paris (FR)

(73) Assignee: Kymab Limited, Cambridge (GB)

( * ) Notice: Subject to any disclaimer, the term of this patent is extended or adjusted under 35 U.S.C. 154(b) by 833 days.

(21) Appl. No.: 17/779,504

(22) PCT Filed: Nov. 27, 2020

(86) PCT No.: PCT/EP2020/083677
§ 371 (c)(1),
(2) Date: May 24, 2022

(87) PCT Pub. No.: WO2021/105389
PCT Pub. Date: Jun. 3, 2021

(65) Prior Publication Data
US 2023/0025129 A1 Jan. 26, 2023

(30) Foreign Application Priority Data

Nov. 29, 2019 (GB) ..................................... 1917524
Dec. 6, 2019 (GB) ..................................... 1917882

(51) Int. Cl.
| | |
|---|---|
| *C07K 16/28* | (2006.01) |
| *A61K 38/17* | (2006.01) |
| *A61K 38/22* | (2006.01) |
| *A61K 39/395* | (2006.01) |
| *A61K 48/00* | (2006.01) |
| *A61P 7/06* | (2006.01) |

(52) U.S. Cl.
CPC ............ *C07K 16/28* (2013.01); *A61K 38/179* (2013.01); *A61K 38/22* (2013.01); *A61K 39/3955* (2013.01); *A61K 48/005* (2013.01); *A61P 7/06* (2018.01); *C07K 2317/21* (2013.01)

(58) Field of Classification Search
None
See application file for complete search history.

(56) References Cited

U.S. PATENT DOCUMENTS

2005/0054027 A1 3/2005 Harris et al.

FOREIGN PATENT DOCUMENTS

| | | |
|---|---|---|
| CN | 105219780 A | 1/2016 |
| WO | WO-2008009895 A2 | 1/2008 |
| WO | 2016/071701 A1 | 5/2016 |
| WO | 2016/085852 A1 | 6/2016 |
| WO | WO-2017023699 A1 | 2/2017 |

OTHER PUBLICATIONS

Wake et al., bloodjournal Blood blood (2019) 134 (Supplement_1) :3532 (Year: 2019).*
Jian-Feng Yang, et al., "Generation and Identification of a Polyclonal Antibody to Matriptase-2", Chinese Journal of Hemorheology, 2014, pp. 472-475, vol. 24, No. 4.
Matthew Wake, "Generation and Characterization of KY1066, a Fully Human Antibody Targeting the Enzymatic Activity of Matriptase-2 for the Treatment of Iron Overload in Beta Thalassemia", Blood, Nov. 13, 2019, p. 3532, vol. 134, supplement 1.
Anna-Madeleine Beckmann, et al., "En Route to New Therapeutic Options for Iron Overload Diseases: Matriptase-2 as a Target for Kunitz-Type Inhibitors", Chembiochem: a European Journal of Chemical Biology, Apr. 1, 2016, pp. 595-604, vol. 17, No. 7.
Mihiret Tekeste Sisay, et al., "Identification of the First Low-Molecular-Weight Inhibitors of Matriptase-2", Journal of Medicinal Chemistry, Aug. 12, 2010, pp. 5523-5535, vol. 53, No. 15.
François Béliveau, et al., "Discovery and Development of TMPRSS6 Inhibitors Modulating Hepcidin Levels in Human Hepatocytes", Cell Chemical Biology, Sep. 19, 2019, pp. 1559-1572, vol. 26, No. 11.
Jana Frýdlová, et al., "Effect of Erythropoietin, Iron Deficiency and Iron Overload on Liver Matriptase-2 (TMPRSS6) Protein Content in Mice and Rats", PLoS One, Feb. 4, 2016, p. e0148540, vol. 11, No. 2.
Mathieu Dondelinger, et al., "Understanding the Significance and Implications of AntibodyAntigen-Binding Surface/Residue Definition", Frontiers in Immunology, Oct. 16, 2018, pp. 1-15, vol. 9, No. 2278.
Delphine Meynard, et al., "Regulation of TMPRSS6 by BMP6 and iron in human cells and mice", Blood, 2011, pp. 747-756, vol. 118, No. 3.
Julia E. Maxson, et al., "Matriptase-2- and proprotein convertase-cleaved forms of hemojuvelin have different roles in the down-regulation of hepcidin expression", Journal of Biological Chemistry, 2010, pp. 39021-39028, vol. 285, No. 50.

* cited by examiner

*Primary Examiner* — Christina M Borgeest
(74) *Attorney, Agent, or Firm* — Grimes & Yvon LLP

(57) ABSTRACT

Antibodies to the enzyme matriptase-2 (MTP-2) are presented. Inhibiting MTP-2 reduces uptake of dietary iron and reduces the release of iron from cellular stores in the body. Inhibitors of MTP-2 (such as antibodies to the serine protease domain) can be used to treat iron overload, which is a feature of diseases such as beta-thalassaemia and which otherwise leads to toxic accumulation of iron. Combination of an MTP-2 inhibitor with an activin receptor ligand trap, or with erythropoietin, provides additional therapeutic effects.

22 Claims, 25 Drawing Sheets

Specification includes a Sequence Listing.

a
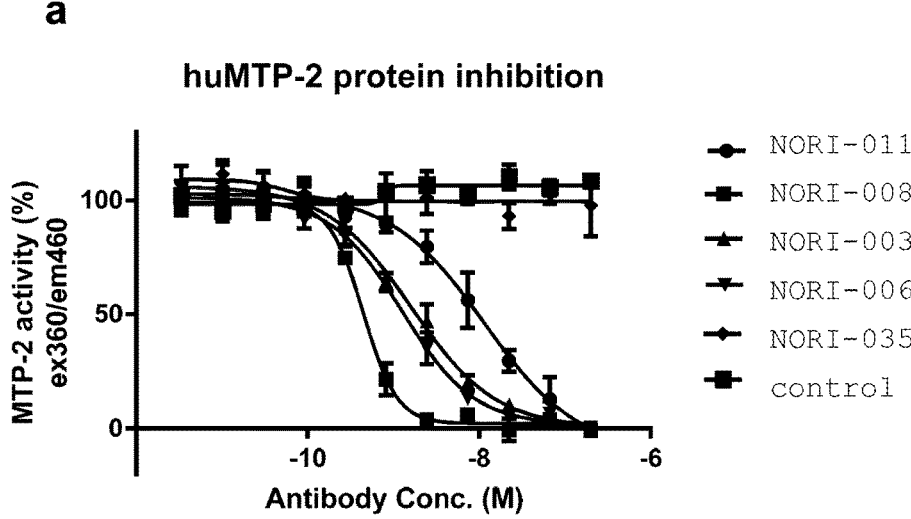
b
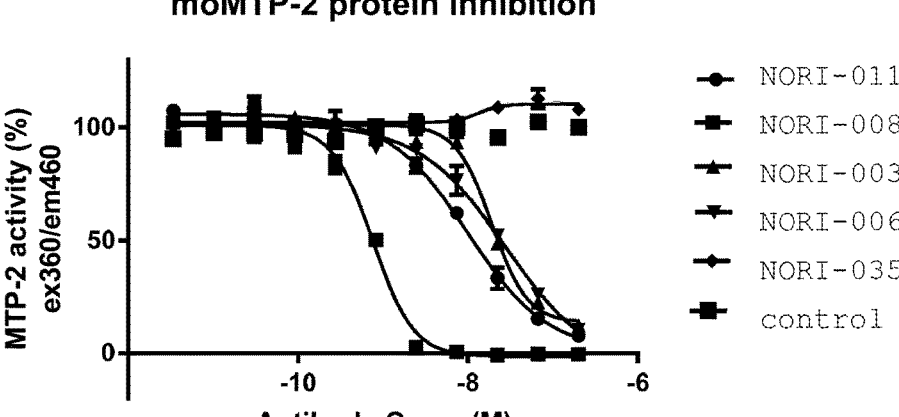
Figure 3

A
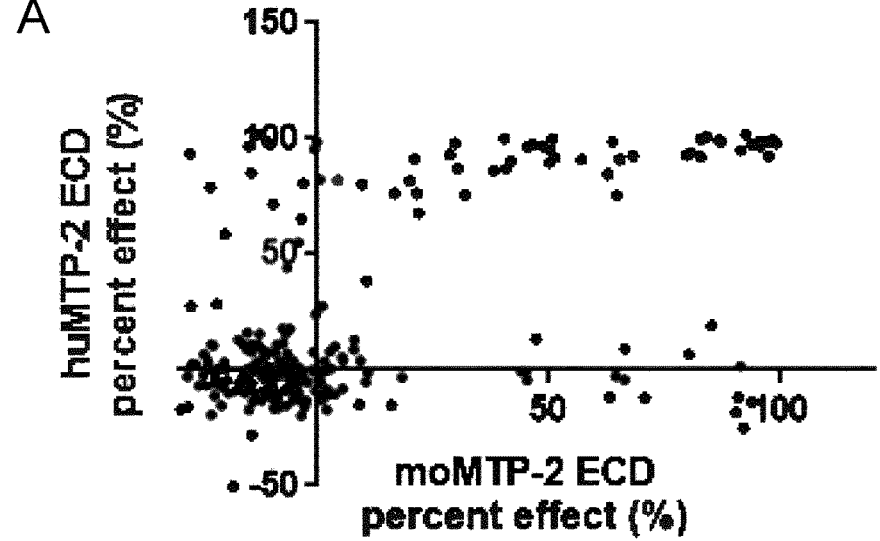
B
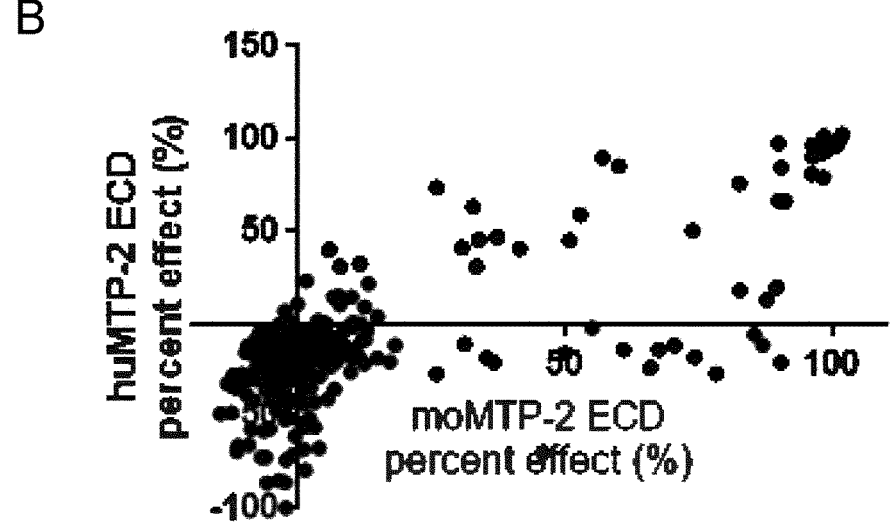
Figure 4 a
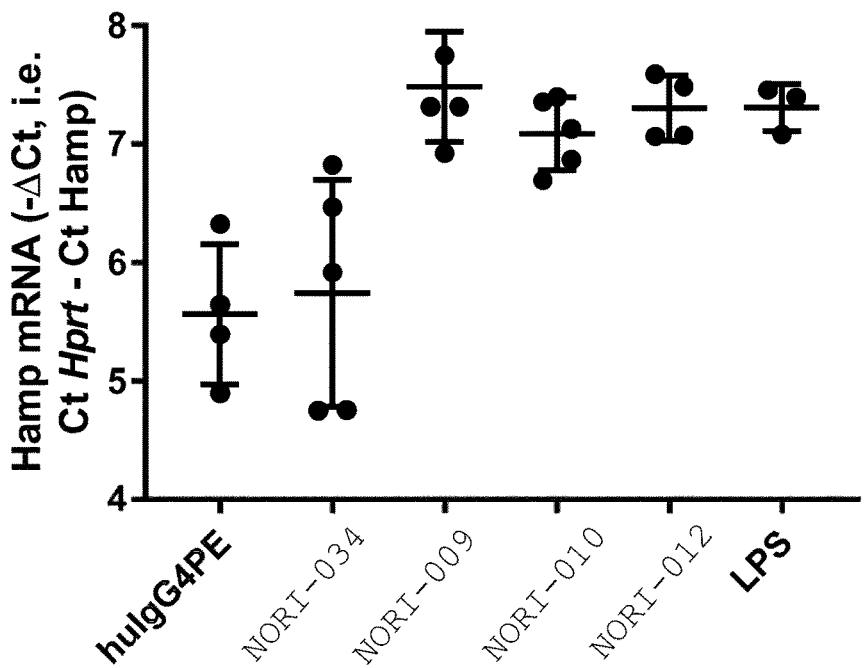
b
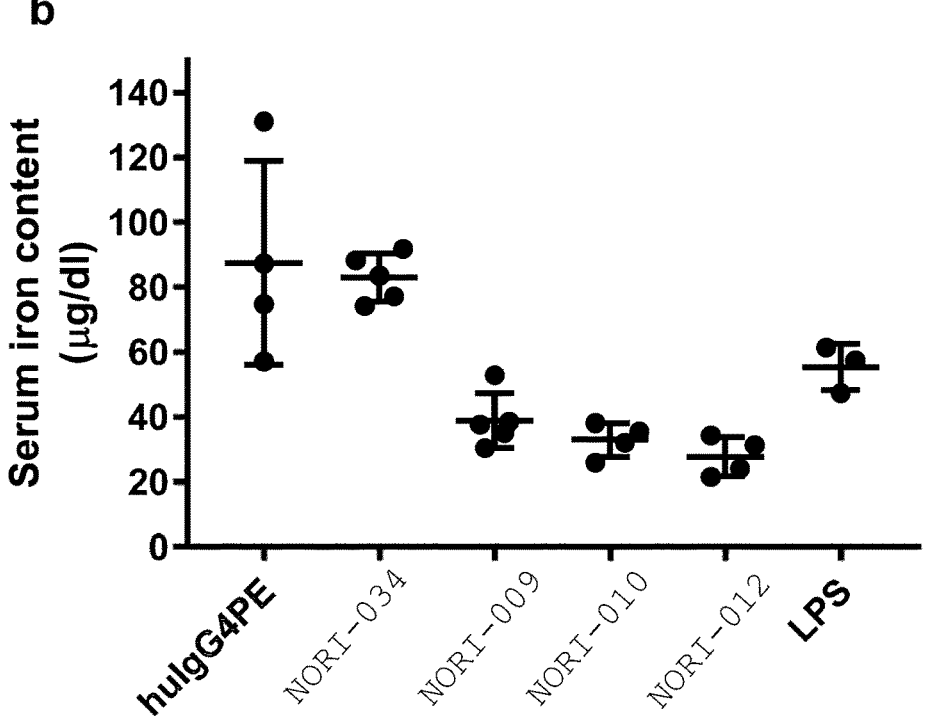
Figure 9 a
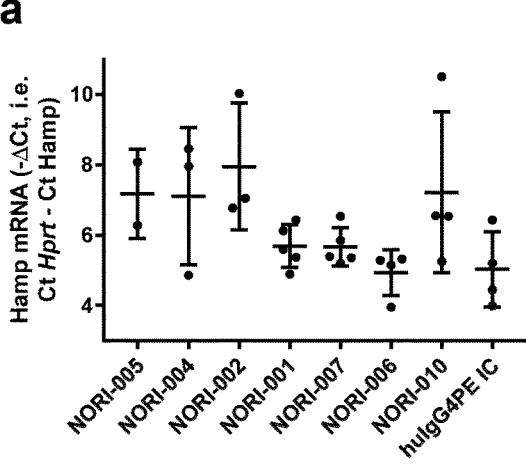
b
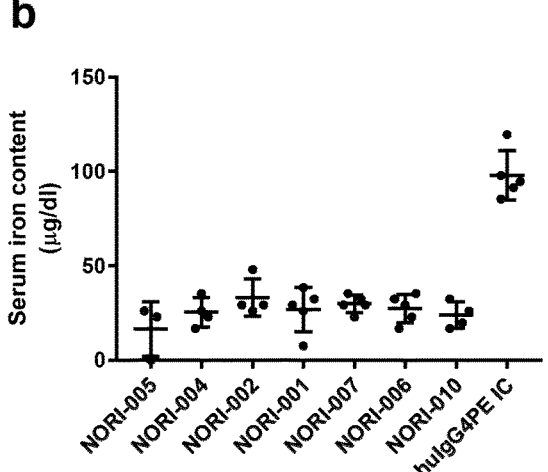
c
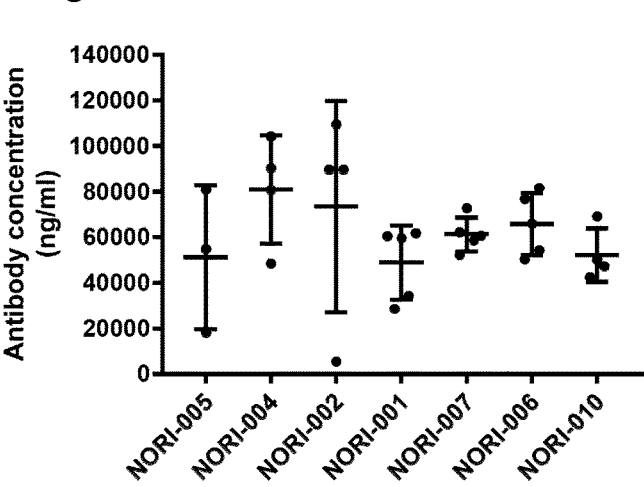
Figure 14 a
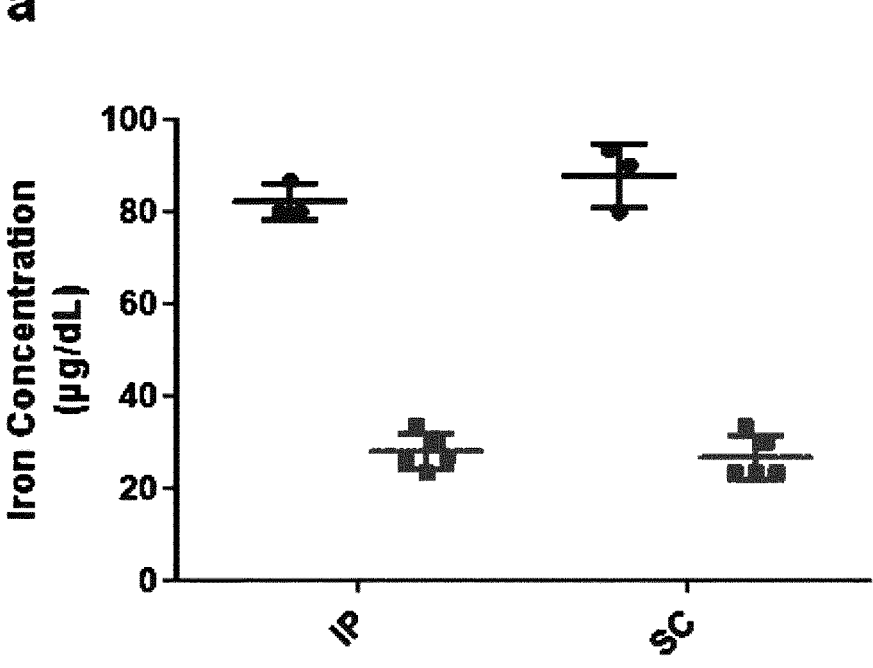
b
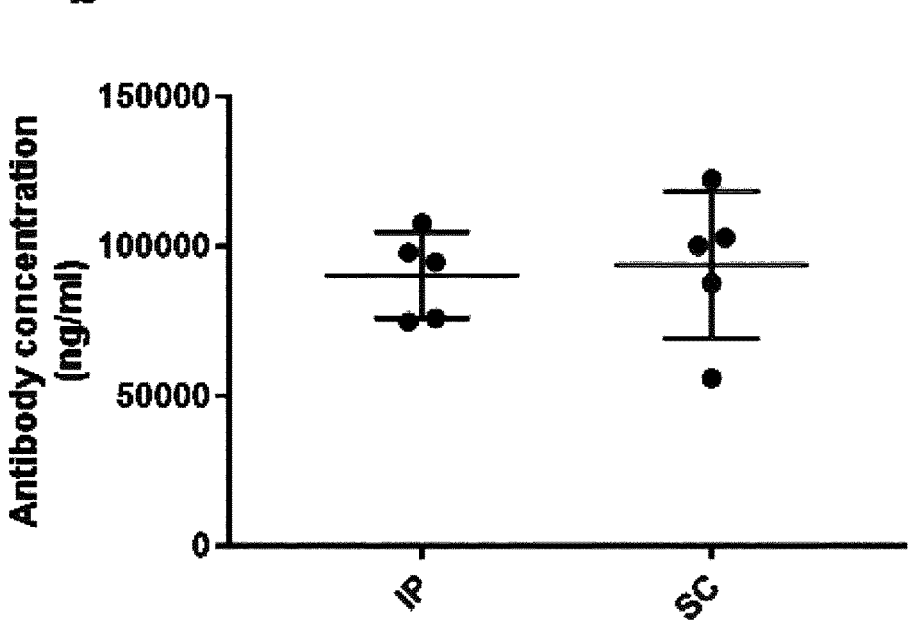
Figure 16 a
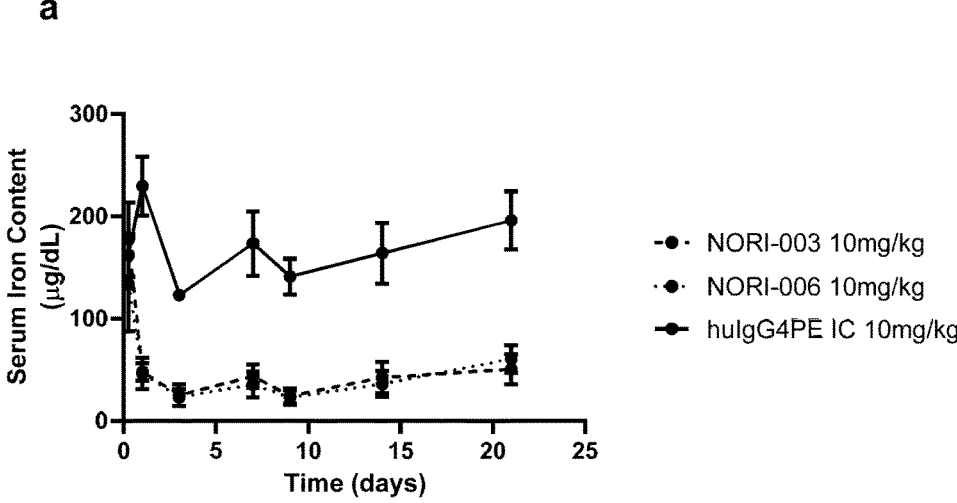
-●- NORI-003 10mg/kg
·●· NORI-006 10mg/kg
-●- huIgG4PE IC 10mg/kg
b
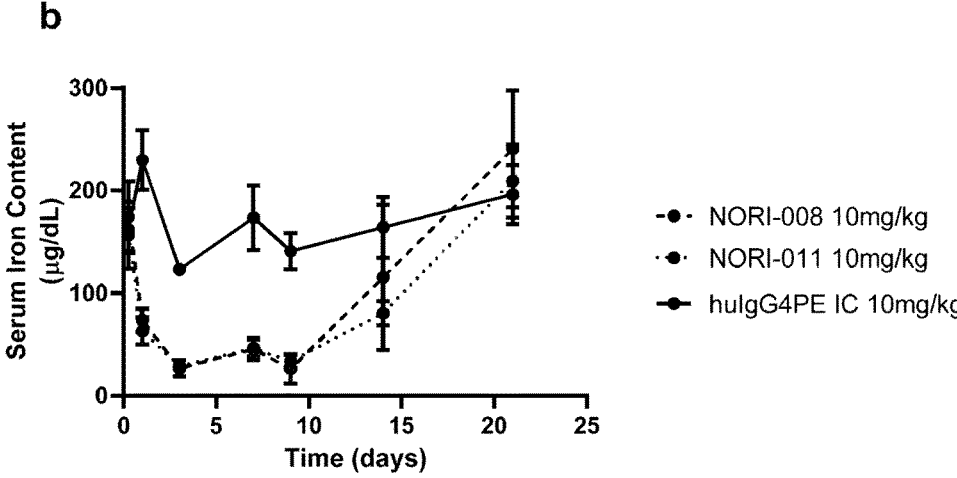
-●- NORI-008 10mg/kg
·●· NORI-011 10mg/kg
-●- huIgG4PE IC 10mg/kg
Figure 18 a -b

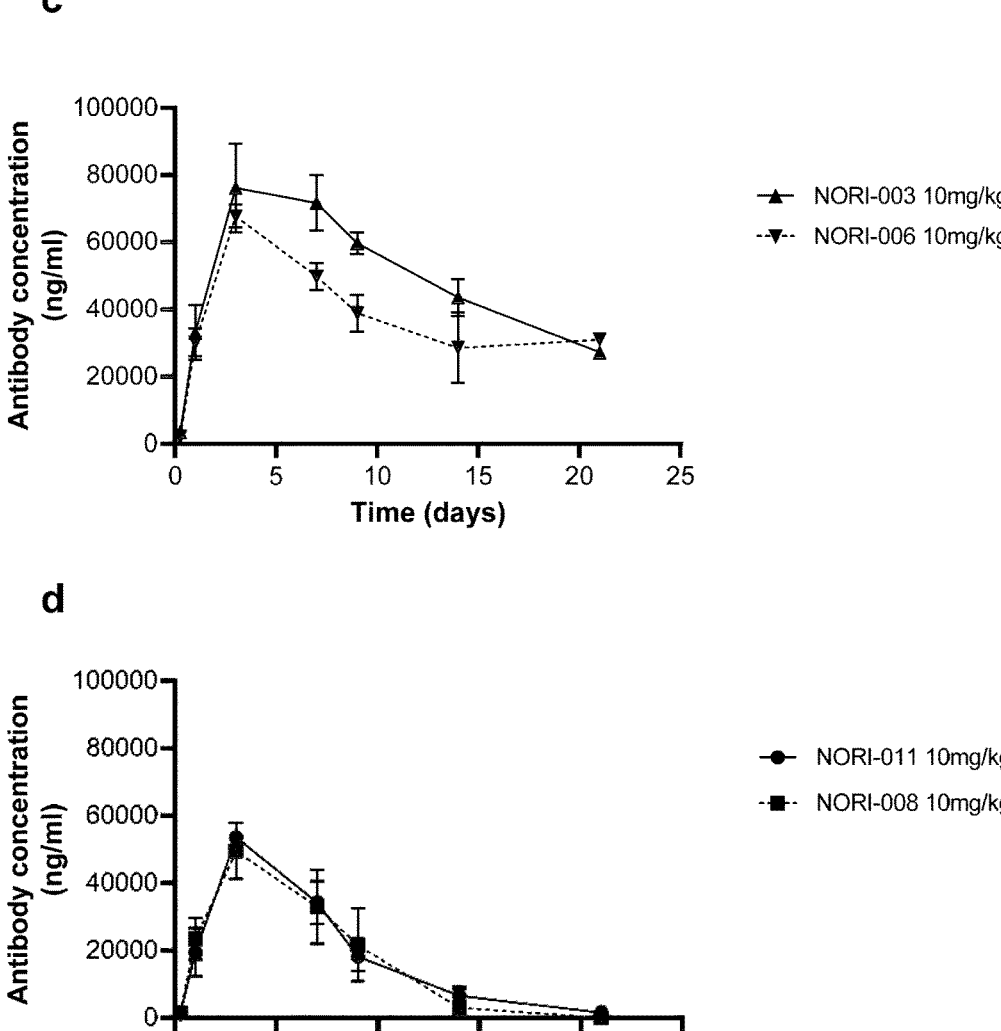
Figure 18 c - d

Figure 20 a - h

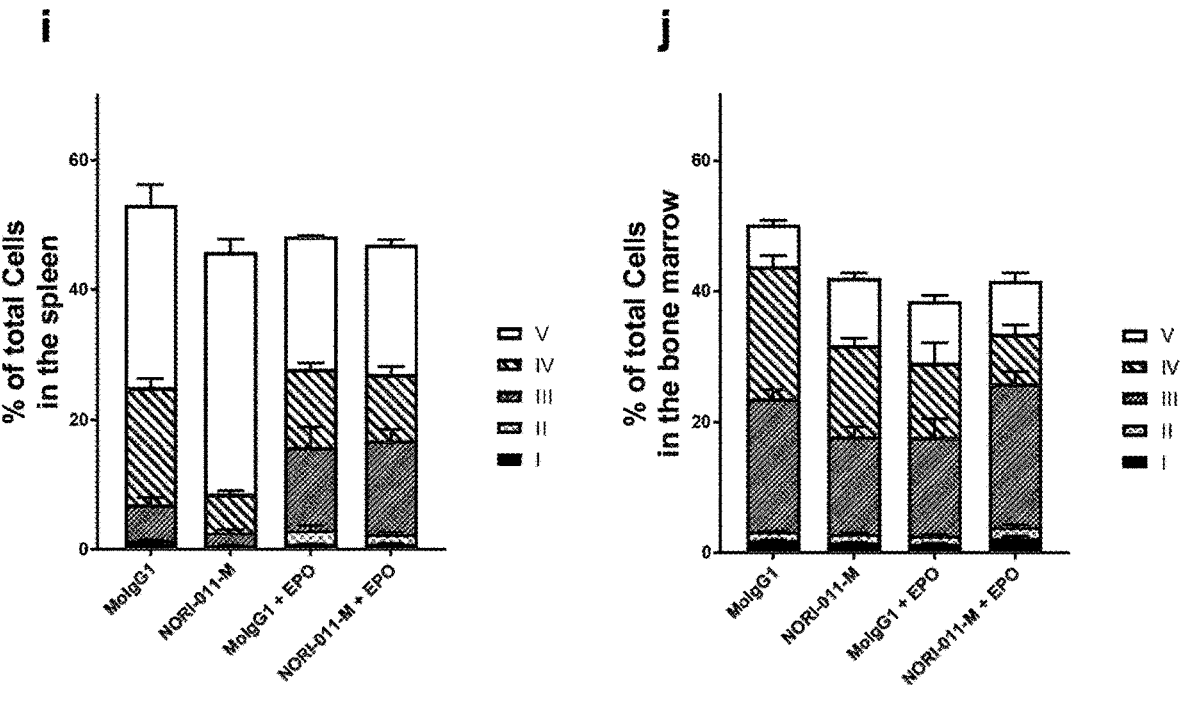
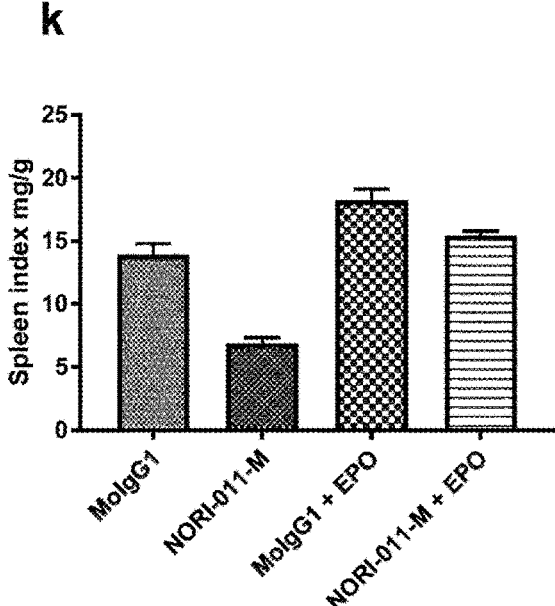
Figure 20 i - k

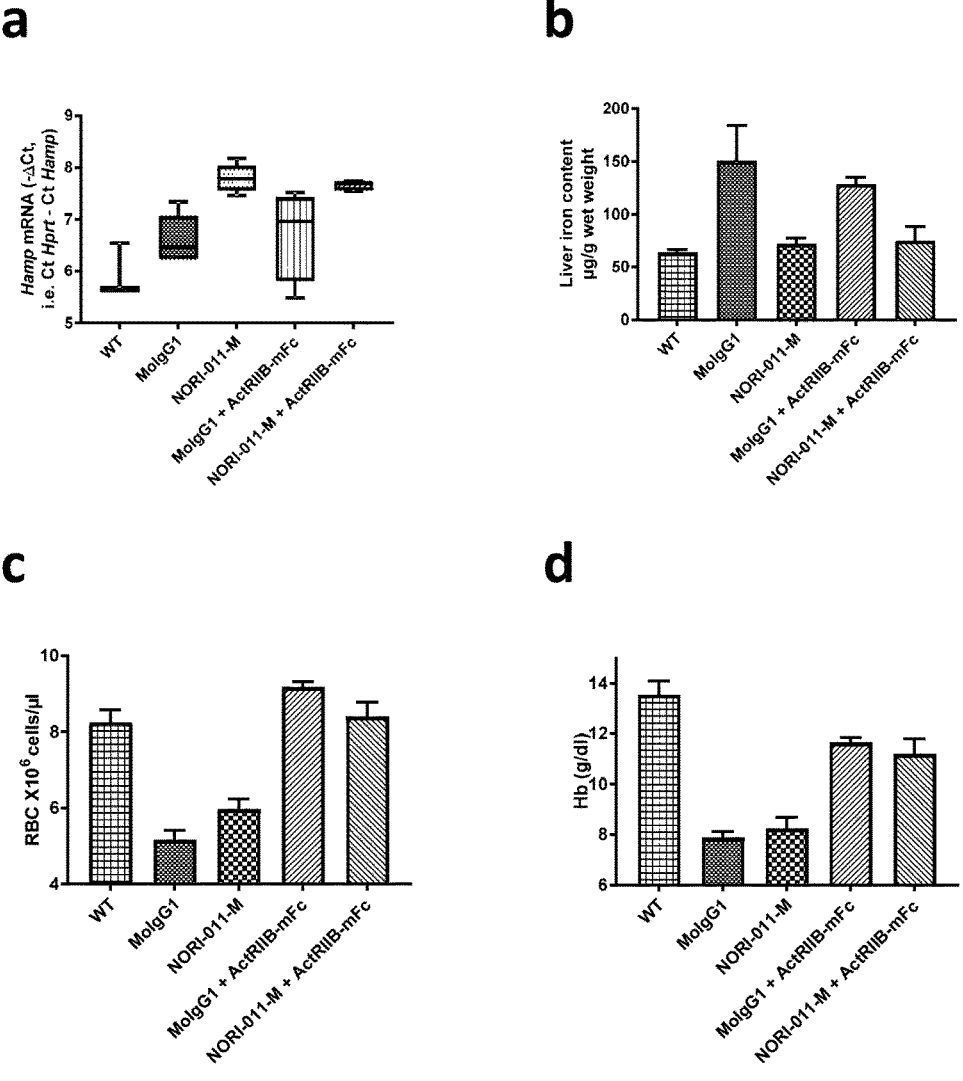
Figure 21 a-d

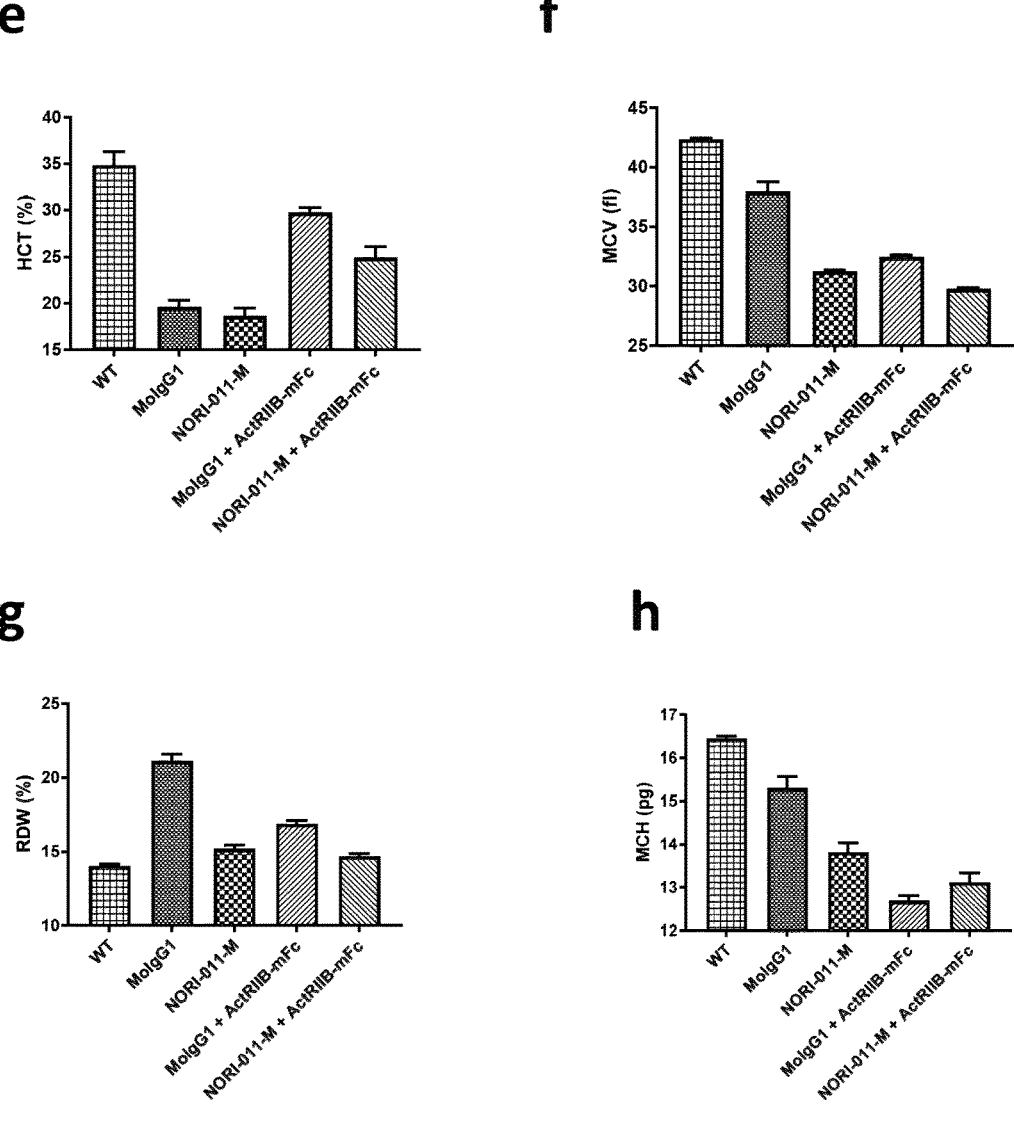
Figure 21 e-h

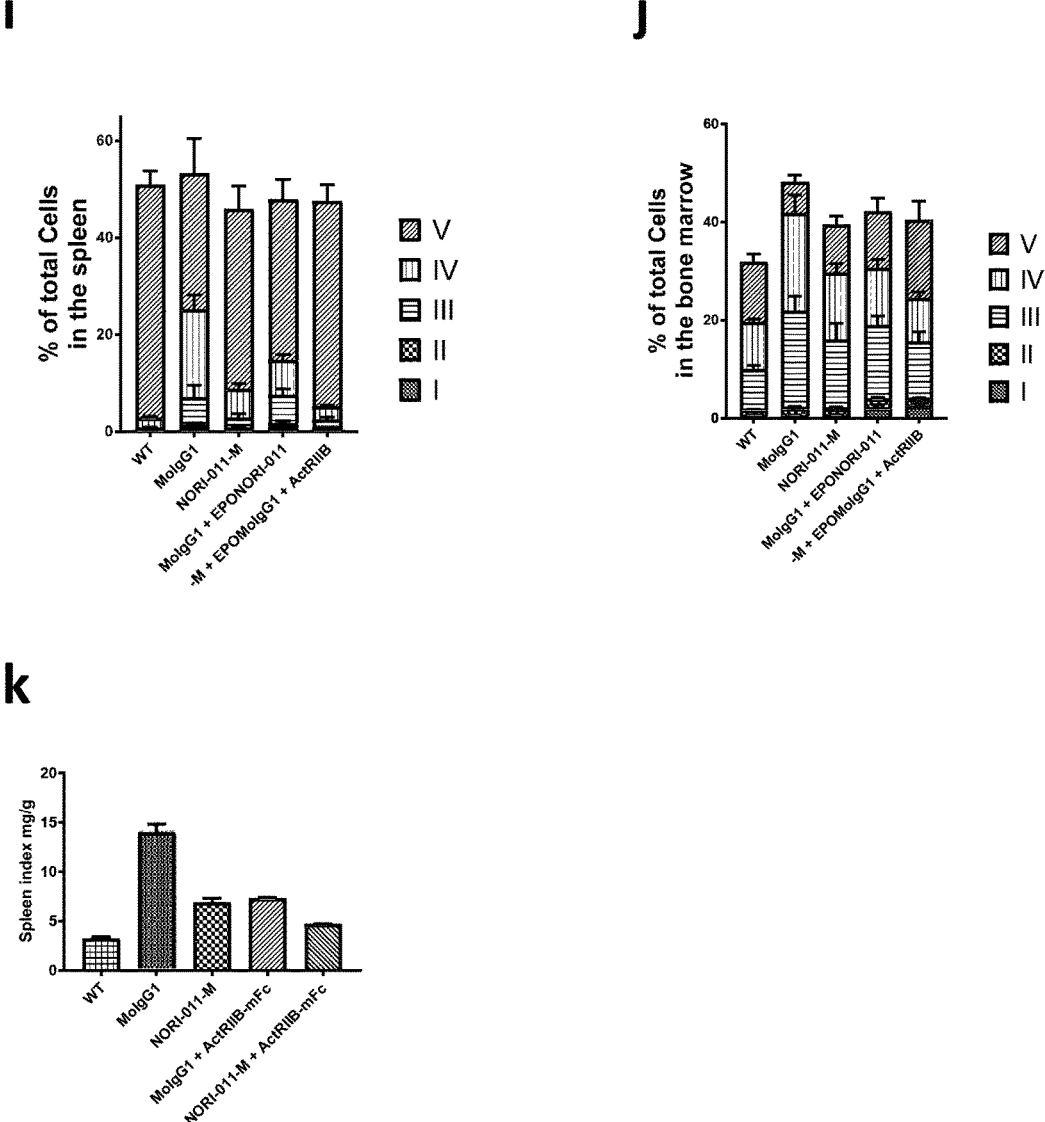
Figure 21 i-k

TREATMENT FOR PHYSIOLOGICAL IRON OVERLOAD WITH AN ANTI-MATRIPTASE-2 ANTIBODY

CROSS REFERENCE TO RELATED APPLICATIONS

This application is a national stage application under 35 U.S.C. § 371 of International Application No. PCT/EP2020/083677, filed internationally on Nov. 27, 2020, which claims the benefit of United Kingdom Application No. 1917882.1, filed Dec. 6, 2019 and United Kingdom Application No. 1917524.9, filed Nov. 29, 2019, the entire contents of each which are incorporated by reference herein.

SUBMISSION OF SEQUENCE LISTING ON ASCII TEXT FILE

The content of the following submission on ASCII text file is incorporated herein by reference in its entirety: a computer readable form (CRF) of the Sequence Listing (file name: 165062000800SEQLIST.TXT, date recorded: May 23, 2022, size: 673,024 bytes).

FIELD OF THE INVENTION

The present invention relates to medicaments that reduce iron overload in patients having conditions such as beta-thalassaemia and myelodysplastic syndrome (MDS).

BACKGROUND

Iron is essential for erythropoiesis, the production of erythrocytes (red blood cells) which transport oxygen from the lungs to other tissues of the body. However, excess iron is toxic because of its ability to generate reactive oxygen species, so its absorption by the duodenum must be tightly regulated. The liver peptide hormone hepcidin plays a central role in adjusting iron absorption to the body's iron needs. Hepcidin negatively regulates cellular iron export by promoting the degradation of ferroportin, the only known iron exporter. Ferroportin is expressed on cells that are the major storage compartment for iron such as macrophages and the basolateral side of duodenal enterocytes. The negative regulation of ferroportin by hepcidin therefore limits duodenal iron absorption and the release of iron form iron storage cells such as macrophages. It is well established that activation of the BMP-SMAD signalling pathway in hepatocytes through the secretion of BMP ligands (mainly BMP6) stimulates hepcidin expression. Matriptase-2 (MTP-2), a type-II transmembrane trypsin-like serine protease encoded by the gene Tmprss6, is expressed by hepatocytes and inhibits BMP-SMAD signalling by potentially cleaving BMP co-receptors such as HJV (Knutson, Nutrition Reviews 67:284-288 2009), thereby reducing expression of hepcidin and causing increased uptake of dietary iron and release of iron from cellular stores. The expression of MTP-2 is induced by BMP6, which is essential for the expression of hepcidin, and by excess iron (Meynard et al., Blood 118: 747-756 2011). So although BMP6 stimulates hepcidin expression it also increases expression of a negative regulator maintaining a negative feedback mechanism to prevent iron dysregulation (Wahedi et al., J Biol Chem 292: 18354-18371 2017). FIG. 1.

Iron overload, manifested by higher than normal transferrin iron saturation in the blood, contributes to the morbidity of a number of genetic diseases and other conditions, including beta-thalassaemia, myelodysplastic syndrome (MDS), Blackfan Diamond anaemia, sickle cell disease, polycythemia vera and haemochromatosis.

Beta-thalassaemia is an inherited haemoglobinopathy caused by a genetic defect in the beta-globin gene. In human adults, the haemoglobin is normally composed of four polypeptide (globin) chains—two alpha-globin subunits and two beta-globin subunits—each globin subunit carrying a haem group in which the central iron reversibly binds oxygen. In beta-thalassaemia, the defective production of haemoglobin results in ineffective erythropoiesis, and consequently anaemia (a deficiency in oxygen-carrying erythrocytes). Excessive production of erythropoietin (epo), which is upregulated in response to the anaemia, and/or elevated levels of the erythroblast hormone erythroferrone resulting from the abnormally expanded and ineffective erythropoiesis, have a suppressive effect on the iron regulator hepcidin leading to increased iron absorption from the gut and release from internal stores, causing iron overload. Interestingly, it is not the anaemia per se but the iron overload that is believed to reduce life expectancy in beta-thalassaemia. The increased iron availability results in increased transferrin saturation and haem production which, together with the compensatory increase in expression of alpha-globin, leads to hemichrome formation and an increase in reactive oxygen stress and apoptosis of erythroid progenitors. This highly stimulated but ineffective erythropoiesis leads to a large number of maturing red blood cells not surviving and therefore an enlarged spleen, or splenomegaly, which is also characteristic of the disease.

There are three types of beta-thalassaemia, classified according to the extent of reduction in beta-chain synthesis. The homozygous form, or beta-thalassaemia major, is the most severe form of congenital haemolytic anaemia and is characterised by an absence of, or severely suppressed, functional beta-chain synthesis. Patients require very frequent blood transfusions ("transfusion-dependent beta-thalassaemia"). Beta-thalassaemia intermedia patients, on the other hand, do not require regular blood transfusions and are genetically heterozygous ("transfusion-independent beta-thalassaemia"). There is a third form of beta-thalassaemia called beta-thalassaemia minor, which is a mild asymptomatic condition in which there is only moderate suppression of beta-chain synthesis.

An unfortunate effect of blood transfusions in transfusion-dependent patients is that each transfusion contains at least 200 mg of iron and therefore exacerbates the problem of iron overload and toxic tissue damage caused by non transferrin bound iron, requiring iron chelation therapy. Iron chelators complex non transferrin bound iron in circulation and can shift the equilibrium and liberate iron from tissue to avoid tissue damage. However, chelators do not reduce transferrin saturation and so do not avoid the increased formation of hemichromes and increased apoptosis. Patients remain dependent on transfusion. In addition, iron chelators can have side effects such as kidney failure, toxic neutropenia and diarrhoea. Although transfusions and iron chelation have improved the prognosis for transfusion-dependent patients, the iron overload experienced by some patients today still represents an unmet clinical need.

Similarly, there is an unmet clinical need for treating patients diagnosed with other iron overload anaemias and related disorders. Myelodysplastic syndrome (MDS) is a group of clonal stem cell disorders characterised by ineffective and dysplastic haematopoiesis resulting in one or more cytopenias, and a varying predilection to develop acute myeloid leukaemia (AML). Several forms of MDS are associated with anaemia and toxic iron deposition within erythroid precursors, including MDS with chromosomal deletion of 5 q-(5 q-MDS) and refractory anaemia with ring-sideroblasts (RARS). These forms of MDS are often associated with depressed levels of hepcidin. Often, MDS can be managed with regular blood transfusions, although this may lead to secondary iron overload and reduced overall survival as in beta-thalassaemia. MDS patients are therefore generally treated with an iron chelator when the iron overload reaches a certain threshold.

Another iron overload disease is hereditary haemochromatosis. This is the most common genetic disease in Caucasians and is characterised by a genetic mutation that causes excessive iron absorption and accumulation due to hepcidin deficiency or insensitivity. Type 1 haemochromatosis results from mutations in the HFE gene. Type 2 haemochromatosis results from mutations in either the HJV or HAMP gene. Type 3 haemochromatosis results from mutations in the TFR2 gene. Type 4 haemochromatosis results from mutations in the SLC40A1 gene. Symptoms of the disease include joint pain, abdominal pain, fatigue and weakness. If left untreated, the disease can lead to liver cirrhosis, liver cancer, heart disease and/or failure and diabetes. The current treatment is phlebotomy.

Rare forms of anaemia have also been shown in animal models to benefit from an iron reduction therapy. These include Blackfan Diamond anemia and sickle cell anaemia. Iron deposition within the liver (mainly in parenchymal cells) is also known to promote oxidative stress and fibrosis in diseases like haemochromatosis and hepatitis C infections, as well as the iron loading anaemias. The regulation of iron metabolism is also believed to be important in the development of liver fibrosis and cirrhosis, non-alcoholic fatty liver disease (NAFDL) and non-alcoholic steatohepatitis (NASH). Liver fibrosis often transforms into cirrhosis with loss of liver function and progression into liver cancer.

New medical treatments are being sought for patients with conditions such as those described above. While overall survival can be improved by blood transfusion and iron chelation, these treatments do not address the underlying disease pathology and have undesirable side effects, as noted.

One branch of study involves investigation of the biology of iron overload anaemias, using mice with genetic beta-thalassaemia as a model of the human disease. The Hbbth3/+ mouse exhibits features similar to beta-thalassaemia intermedia in humans, including Hb levels between 7 and 9 g/dL, aberrant erythrocyte morphology, increased reticulocyte count, ineffective and extramedullary erythropoiesis, hepato-splenomegaly, and liver and spleen iron overload a complex phenotype which worsens with aging (Franceschi et al., Haematologica 91:1336-134 2006).

Deleting Tmprss6 (MTP2) or reducing its expression has been shown to increase hepcidin expression, correcting the iron overload, splenomegaly and anaemia in Hbbth3/+ mice (Guo et al., Journal of Clinical Investigation 123:1531-1541 2013; Nai et al., Blood 119:5021-5029 2012). It has been shown that reducing the gene expression of Tmprss6 by using lipid nanoparticle (LNP) formulated-Tmprss6 siRNA in a Hbbth3/+ mouse model of beta thalassaemia induced hepcidin and diminished tissue and serum iron levels. Furthermore, LNP-Tmprss6 siRNA treatment of Hbbth3/+ animals improved erythrocyte survival and erythropoiesis and thus substantially reduced the anaemia (Schmidt et al., Blood 121(7):1200-1208 2013).

Guo et al demonstrated that Hbbth3/+ mice showed a decreased formation of insoluble membrane-bound globins, ROS and apoptosis, and anaemia after treatment with an antisense oligonucleotide against Tmprss6 (Guo et al., 2013, supra). These animals also exhibited lower erythropoietin levels, a significant amelioration of ineffective erythropoiesis and splenomegaly as well as an increase in total haemoglobin levels.

Consistent with these studies, a Tmprss6 knock-out in the genetic background of the thalassaemia mice produced a significant reduction in iron overload and improved haemoglobin levels compared with Tmprss6+ thalassaemia mice.

Gene therapy represents a possible approach to addressing the underlying disease pathology in patients with iron overload diseases. In June 2019, the gene therapy "Zynteglo" received conditional regulatory approval from the EMA for treating transfusion-dependent β-thalassaemia in patients 12 years and older who have no other treatment options. Gene therapy adds a corrective beta-globin gene to the patient's bone marrow stem cells ex vivo, which are then regrafted into the patient. Although potentially curative, this is a highly invasive and hugely expensive procedure. As of November 2019, approval of Zynteglo has been delayed due to manufacturing issues, and it has not been approved for the most severe type of beta-thalassaemia (the β0/β0 genotype) because more than half of such patients who were experimentally treated with Zynteglo had to return to blood transfusions.

Also under clinical investigation are fusion proteins which contain the extracellular domain of the activin type II receptor linked to the Fc portion of human IgG1. These ligand traps act on the transforming growth factor-β (TGFβ) superfamily to increase late-stage erythropoiesis. Sotatercept is an activin type IIA receptor IgG-Fc fusion protein, and luspatercept is an activin type IIB receptor IgG-Fc fusion protein. These proteins have been shown to significantly reduce the need for red blood cell transfusion in iron overload anaemias, but so far they have not proved to be sufficient to achieve transfusion independency (Piga et al., Blood 133:1279-1289 2019).

Luspatercept (Reblozyl) was approved by the FDA on 8 Nov. 2019 to treat anaemia in adults who require regular transfusions in beta thalassaemia, based mainly on data provided by the Phase III BELIEVE trial. The primary clinical end point for this study was the proportion of patients achieving transfusion burden reduction from baseline of at least 33%, with a reduction of at least 2 units from week 13 to week 24. Only 21.4% of patients achieved this and only 7.6% to 10.3% of patients achieved a more than 50% reduction in transfusions in the same time frames. There is therefore still a continued medical need for treatments in beta thalassaemia.

Perhaps the simplest concept of increasing hepcidin levels by therapeutic intervention has been the therapeutic use of hepcidin, hepcidin derivatives or analogues themselves (Casu et al., Blood 128:265-276 2016; Casu, Nemeth & Rivella, Blood 131:1790-1794 2018; Preza et al., Journal of Clinical Investigation 121:4880-4888, 2011). Although a simple treatment concept, no such treatment has yet succeeded in meeting the standards for regulatory approval. At least two of these approaches have been terminated recently following clinical trials (LJPC-401 in a phase II trial with beta thalassaemia with La Jolla Pharmaceuticals and M-021 after Phase I trials with Merganser). Again, the medical need still exists to develop new treatments that are efficacious.

SUMMARY OF THE INVENTION

The present invention relates to binder polypeptides, such as antibodies, which bind and inhibit MTP-2. MTP-2 inhibitory binder polypeptides may be used to reduce iron over-load in patients, including patients with beta-thalassaemia, MSD, and other iron overload anaemias and further conditions described herein. Various aspects of the invention relate to the binder polypeptides, their use for the manufacture of medicaments and in methods of treating patients, methods of producing the binder polypeptides, nucleic acids encoding them, and the formulation of pharmaceuticals in which they are contained.

In a first aspect, the present invention provides a binder polypeptide which binds MTP-2 and inhibits its enzymatic activity. The binder polypeptide may for example bind to the serine protease catalytic domain of MTP-2.

A binder polypeptide according to the present invention may be an antibody (e.g., IgG) or a non-antibody molecule such as an alternative polypeptide scaffold comprising engineered binding loops. We describe antibodies and other binders comprising binding loops for MTP-2 (e.g., for MTP-2 serine protease catalytic domain), which inhibit the enzymatic activity of MTP-2.

Embodiments include the antibodies referred to herein as NORI-001, NORI-002, NORI-003, NORI-004, NORI-005, NORI-006, NORI-007, NORI-008, NORI-009, NORI-010, NORI-011, NORI-012, NORI-013, NORI-014, NORI-015, NORI-016, NORI-017, NORI-018, NORI-019, NORI-020, NORI-021, NORI-022, NORI-023, NORI-024, NORI-025, NORI-026, NORI-027, NORI-028, NORI-029, NORI-030, NORI-031, NORI-032 and NORI-033 ("NORI-001 to NORI-033"). These represent a diverse selection of antibody heavy and light chain sequences. These antibodies are all demonstrated to bind MTP-2 and to inhibit its catalytic activity. Selected example antibodies are also shown to successfully reduce hepcidin expression in vivo, which represents modulation of the key biological process in physiological iron overload and indicates the potential of inhibitory anti-MTP-2 binder polypeptides to treat blood disorders and other conditions associated with iron overload.

A binder polypeptide according to the present invention may be an antibody comprising a VH domain and a VL domain, the VH domain comprising a set of heavy chain complementarity determining regions (HCDRs) HCDR1, HCDR2 and HCDR3 and the VL domain comprising a set of light chain complementarity determining regions (LCDRs) LCDR1, LCDR2 and LCDR3.

An antibody may comprise an HCDR1, HCDR2 and/or an HCDR3 which is the HCDR1, the HCDR2 or the HCDR3 of any of NORI-001 to NORI-033 and/or it may comprise an LCDR1, an LCDR2 or an LCDR3 which is the LCDR1, the LCDR2 or the LCDR3 of any of NORI-001 to NORI-033. For example, the antibody may comprise the HCDR3 of NORI-001, NORI-002, NORI-003, NORI-004, NORI-005, NORI-006, NORI-007, NORI-008, NORI-009, NORI-010, NORI-011, NORI-012, NORI-013, NORI-014, NORI-015, NORI-016, NORI-017, NORI-018, NORI-019, NORI-020, NORI-021, NORI-022, NORI-023, NORI-024, NORI-025, NORI-026, NORI-027, NORI-028, NORI-029, NORI-030, NORI-031, NORI-032 or NORI-033.

An antibody may comprise a set of HCDRs which is the set of HCDRs of the VH domain of any of NORI-001 to NORI-033 and/or it may comprise a set of LCDRs which is the set of LCDRs of the VL domain of any of NORI-001 to NORI-033. For example, the antibody may comprise the HCDRs and the LCDRs of NORI-001, NORI-002, NORI-003, NORI-004, NORI-005, NORI-006, NORI-007, NORI-008, NORI-009, NORI-010, NORI-011, NORI-012, NORI-013, NORI-014, NORI-015, NORI-016, NORI-017, NORI-018, NORI-019, NORI-020, NORI-021, NORI-022, NORI- 023, NORI-024, NORI-025, NORI-026, NORI-027, NORI-028, NORI-029, NORI-030, NORI-031, NORI-032 or NORI-033.

A binder polypeptide may comprise a VH domain having at least 90% amino acid sequence identity with the VH domain of any of NORI-001 to NORI-033 and/or it may comprise a VL domain having at least 90% amino acid sequence identity with the VL domain of any of NORI-001 to NORI-033. For example, the binder polypeptide may comprise the VH domain and the VL domain of NORI-001, NORI-002, NORI-003, NORI-004, NORI-005, NORI-006, NORI-007, NORI-008, NORI-009, NORI-010, NORI-011, NORI-012, NORI-013, NORI-014, NORI-015, NORI-016, NORI-017, NORI-018, NORI-019, NORI-020, NORI-021, NORI-022, NORI-023, NORI-024, NORI-025, NORI-026, NORI-027, NORI-028, NORI-029, NORI-030, NORI-031, NORI-032 or NORI-033, or a variant VH and/or VL domain sharing 90% sequence identity with said VH and/or VL domain.

In a first configuration, an antibody comprises
a VH domain which comprises the NORI-003 HCDRs and has at least 90% sequence identity with the VH domain of NORI-003, and
a VL domain which comprises the NORI-003 LCDRs and has at least 90% sequence identity with the VL domain of NORI-003.

The antibody may comprise the NORI-003 VH domain and the NORI-003 VL domain. Optionally, the antibody is an IgG comprising the NORI-003 heavy chain and the NORI-003 light chain.

In a second configuration, an antibody comprises
a VH domain which comprises the NORI-006 HCDRs and has at least 90% sequence identity with the VH domain of NORI-006, and
a VL domain which comprises the NORI-006 LCDRs and has at least 90% sequence identity with the VL domain of NORI-006.

The antibody may comprise the NORI-006 VH domain and the NORI-006 VL domain. Optionally, the antibody is an IgG comprising the NORI-006 heavy chain and the NORI-006 light chain.

In a third configuration, an antibody comprises
a VH domain which comprises the NORI-008 HCDRs and has at least 90% sequence identity with the VH domain of NORI-008, and
a VL domain which comprises the NORI-008 LCDRs and has at least 90% sequence identity with the VL domain of NORI-008.

The antibody may comprise the NORI-008 VH domain and the NORI-008 VL domain. Optionally, the antibody is an IgG comprising the NORI-008 heavy chain and the NORI-008 light chain.

In a fourth configuration, an antibody comprises
a VH domain which comprises the NORI-011 HCDRs and has at least 90% sequence identity with the VH domain of NORI-011, and
a VL domain which comprises the NORI-011 LCDRs and has at least 90% sequence identity with the VL domain of NORI-011.

The antibody may comprise the NORI-011 VH domain and the NORI-011 VL domain. Optionally, the antibody is an IgG comprising the NORI-011 heavy chain and the NORI-011 light chain.

In various embodiments of the invention, the % sequence identity shared by the VH and/or VL domain is optionally higher than 90%, for example it may be 95% or greater, 98% or greater or 99% or greater.

A binder polypeptide may comprise an antibody VH domain produced by recombination of v, d and j gene segments which are the v, d and j gene segments from which the VH domain of any of NORI-001 to NORI-033 was produced. A binder polypeptide may comprise an antibody VL domain produced by recombination of v and j gene segments which are the v and j gene segments from which the VL domain of any of NORI-001 to NORI-033 was produced. For example, a binder polypeptide may comprise a VH domain produced by recombination of v, d and j gene segments from which the VH domain of any of NORI-001 to NORI-003 was produced and it may comprise an antibody VL domain produced by recombination of v and j gene segments which are the v and j gene segments from with the VL domain of said antibody was produced.

Inhibition of MTP-2 enzymatic activity may be determined in an in vitro assay for inhibition of serine protease cleavage of a substrate of MTP-2 to generate a detectable product. Such an in vitro enzymatic assay may comprise contacting the polypeptide with MTP-2 or MTP-2 extracellular domain and detecting the extent to which generation of the detectable product is reduced relative to a control assay lacking the polypeptide (a negative control polypeptide may be included instead). The enzymatic assay may be performed with the polypeptide at a range of concentrations, to produce a dose-response curve from which an IC50 value may be calculated. Thus an inhibitor according to the present invention may be identified through its dose-dependent inhibition in such an enzymatic assay.

A suitable in vitro enzymatic assay is an enzymatic assay with MTP-2 and 50 µM final concentration fluorescent MTP-2 substrate. An exemplary substrate is Boc-Gln-Gly-Arg-AMC, currently obtainable as Baychem 4016429. The MTP-2 in such an assay may have an activity rate of 0.075 U/µl. MTP-2 may be provided as purified protein in solution, e.g., MTP-2 extracellular domain. Accordingly, IC50 for a binder polypeptide may be determined in an enzymatic assay with purified MTP-2 extracellular domain with an activity rate of 0.075 U/µl in the presence of 50 µM Boc-Gln-Gly-Arg-AMC fluorescent substrate. A binder polypeptide may have an IC50 of less than 100 nM in such as assay.

As an alternative to purified ECD, inhibition may be assayed in vitro with cell-surface expressed MTP-2 in a cell-based assay, e.g., using HEK293 cells.

The effects of MTP-2 inhibition (e.g., reducing expression of hepcidin, measurable as a reduction in mRNA of its encoding gene hamp) may further be detected in vivo, confirming inhibitory activity and biological relevance.

In various embodiments, potency of the inhibitor is quantified according to its IC50 measured in an in vitro assay (e.g., an assay as described above) for inhibition of MTP-2 enzymatic activity. Preferably, a binder polypeptide according to the present invention has an IC50 less than 100 nM, less than 80 nM, less than 60 nM, less than 50 nM, less than 40 nM, less than 30 nM, less than 25 nM, less than 20 nM, less than 15 nM or less than 10 nM in an in vitro assay for inhibition of MTP-2 enzymatic activity. The IC50 is optionally at least 0.01 nM, at least 0.1 nM, at least 1 nM, at least 2 nM, at least 3 nM or at least 5 nM.

Potency may be compared for reference against one or more anti-MTP-2 antibodies described herein. For example, an antibody comprising the VH and VL domains of any of NORI-001 to NORI-033 may be used as a reference antibody. The reference antibody may be provided as an IgG. For example, a binder polypeptide according to the present invention may have an IC50 within 25% or within 10% of the IC50 of any of NORI-001 to NORI-033, e.g., NORI-003 IgG, NORI-006 IgG, NORI-008 IgG, NORI-009 IgG, or NORI-011 IgG, or it may have an IC50 which is lower than the IC50 of said reference antibody. By "within x % of" it is meant that the IC50 of the test binder polypeptide is no more than x % greater than and no more than x % less than the IC50 of the reference antibody.

Inhibition potency may be compared against that of aprotinin, a 6500 Dalton pan serine protease inhibitor known to occupy the active site of serine proteases. The IC50 of a binder polypeptide may be similar to or less than the IC50 of aprotinin. A binder polypeptide may have an IC50 within 50%, within 25% or within 10% of the IC50 of aprotinin.

In one embodiment, assays for MTP-2 inhibition are performed with human MTP-2. In another embodiment, assays for MTP-2 inhibition are performed with non-human (e.g., mouse, rat or cynomolgus monkey) MTP-2. Comparison of the inhibition potency of a binder polypeptide in the same enzymatic assay using MTP-2 of different species provides an indication of the species cross-reactivity of the binder polypeptide. In general, species cross-reactivity is desirable since it enables the possibility of testing the binder polypeptide in vivo in multiple species—for example preclinical work in laboratory animals (e.g., mice, rats or cynomolgus monkey) may be performed prior to clinical work in the target species (e.g., human). Preferably, a binder polypeptide according to the present invention is cross-reactive for binding and inhibiting MTP-2 of multiple species. Preferably, it binds and inhibits human and mouse MTP-2. More preferably, it binds and inhibits human, mouse, rat and cynomolgus monkey MTP-2.

A binder polypeptide may have an IC50 in an in vitro assay for inhibition of non-human (e.g., mouse, rat and/or cynomolgus) MTP-2 enzymatic activity which is within 50%, within 25% or within 20% of its IC50 in an in vitro assay for inhibition of human MTP-2 enzymatic activity.

A binder polypeptide may have an IC50 in an in vitro assay for inhibition of non-human (e.g., mouse, rat and/or cynomolgus) MTP-2 enzymatic activity which is less than 100-fold different, less than 50-fold different, less than 10-fold different, less than 5-fold different, or less than 2-fold different less than 50-fold different, less than 10-fold different, less than 5-fold different, or less than 2-fold different from its IC50 in an in vitro assay for inhibition of human MTP-2 enzymatic activity.

Similarly, another measure of species cross-reactivity can be provided by comparing affinity of a binder polypeptide for MTP-2 of one species against its affinity for MTP-2 of another species. Binding affinity ($K_D$) as determined for example by surface plasmon resonance can be compared. $K_D$ of a binding polypeptide for binding non-human (e.g., mouse, rat and/or cynomolgus) MTP-2 may be less than 50-fold different, less than 10-fold different, less than 5-fold different, or less than 2-fold different from its $K_D$ for binding human MTP-2.

The ability of a binder polypeptide to compete with a reference molecule for binding to MTP-2 may be determined in vitro. Competition for binding to MTP-2 may be determined in an assay using full-length MTP-2, the MTP-2 extracellular domain, the serine protease catalytic domain and/or optionally other isolated fragments or domains selected according to the region of MTP-2 which is bound by the reference molecule. For example, a binder polypeptide according to the present invention may be one which competes with aprotinin for binding to MTP-2. A binder polypeptide according to the present invention may be one which competes for binding to MTP-2 with any anti-MTP-2 antibody described herein. For example, an antibody comprising the VH and VL domains of any of NORI-001 to NORI-033 may be used as a reference antibody. The reference antibody may be provided as an IgG. For example, in various embodiments, a binder polypeptide may be one which competes with NORI-003 IgG, NORI-006 IgG, NORI-008 IgG or NORI-011 IgG for binding to MTP-2. Alternatively, the reference antibody may be provided as an scFv. For example, in various embodiments, a binder polypeptide may be one which competes with NORI-003 scFv, NORI-006 scFv, NORI-008 scFv or NORI-011 IgG for binding to MTP-2.

IC50 in a competition assay may be determined. For example, a binder polypeptide may have an IC50 of less than 20 nM in a competition assay with labelled aprotinin for binding to human MTP-2. The 58 amino acid mature sequence of aprotinin, as shown in Table S, may be used in a competition assay.

Nucleic acid encoding binder polypeptides as described herein is also provided, as are cells comprising said nucleic acid. A host cell in vitro may comprise the nucleic acid, optionally integrated into its cellular (e.g., genomic) DNA, or transiently transfected (e.g., plasmid DNA).

These and other aspects and embodiments of the invention, including methods of producing binder polypeptides, pharmaceutical compositions, and methods of treating patients, are described in more detail below.

Clauses

Antibodies to the enzyme matriptase-2 (MTP-2) are presented. Inhibiting MTP-2 reduces uptake of dietary iron and reduces the release of iron from cellular stores in the body. Inhibitors of MTP-2 (such as antibodies to the serine protease domain) can be used to treat iron overload, which is a feature of diseases such as beta-thalassaemia and which otherwise leads to toxic accumulation of iron. Combination of an MTP-2 inhibitor with an activin receptor ligand trap, or with erythropoietin, provides additional therapeutic effects.

The following numbered clauses represent embodiments of the present invention and are part of the description.

1. An isolated binder polypeptide which binds MTP-2 and inhibits its enzymatic activity, optionally wherein the binder polypeptide binds the serine protease catalytic domain of MTP-2.

2. A binder polypeptide according to clause 1, comprising an immunoglobulin domain in which a binding site for MTP-2 is formed by loop regions of the immunoglobulin domain.

3. A binder polypeptide according to clause 2, which is an antibody, optionally a human antibody.

4. A binder polypeptide according to any preceding clause, wherein the MTP-2 is human MTP-2.

5. A binder polypeptide according to clause 4, wherein the MTP-2 is human MTP-2 and mouse MTP-2.

6. A binder polypeptide according to clause 4 or clause 5, which binds human MTP-2 comprising sequence polymorphisms in which residue 253 is K or E and residue 736 is V or A.

7. A binder polypeptide according to any preceding clause, which does not bind MTP-1 and optionally does not bind other members of the type II transmembrane serine protease family.

8. A binder polypeptide according to any preceding clause, which exhibits dose-dependent inhibition of MTP-2 serine protease activity in an enzymatic assay with MTP-2 extracellular domain and 50 μM final concentration fluorescent MTP-2 substrate.

9. A binder polypeptide according to clause 8, which has an IC50 less than 100 nM in an enzymatic assay against human MTP-2 extracellular domain and 50 μM final concentration fluorescent MTP-substrate.

10. A binder polypeptide according to clause 8 or clause 9, which has an IC50 less than 100 nM in an enzymatic assay against mouse MTP-2 extracellular domain and 50 μM final concentration fluorescent MTP-substrate.

11. A binder polypeptide according to clause 10, which has an IC50 in the enzymatic assay with mouse MTP-2 extracellular domain which is less than 100-fold different from its IC50 in said assay with human MTP-2 extracellular domain.

12. A binder polypeptide according to any preceding clause, which exhibits dose-dependent inhibition of MTP-2 serine protease activity in an enzymatic assay with HEK293 cell surface expressed human MTP-2 and 50 μM final concentration fluorescent MTP-2 substrate.

13. A binder polypeptide according to clause 11, which has an IC50 less than 100 nM in an enzymatic assay with HEK293 cell surface expressed human MTP-2 and 50 μM final concentration fluorescent MTP-2 substrate.

14. A binder polypeptide according to any preceding clause, which competes with an IgG comprising the VH and VL domain of any of NORI-001 to NORI-033 for binding to human and/or mouse MTP-2.

15. A binder polypeptide according to clause 14, which competes with an IgG comprising the VH and VL domain of NORI-003, NORI-006, NORI-008 or NORI-011 for binding to the serine protease catalytic domain of human and/or mouse MTP-2.

16. A binder polypeptide according to any preceding clause, which competes with aprotinin for binding to the serine protease catalytic domain of human and/or mouse MTP-2.

17. A binder polypeptide according to clause 16, which has an IC50 of less than 100 nM in a competition assay with labelled aprotinin for binding to human and/or mouse MTP-2.

18. A binder polypeptide according to clause 17, which has an IC50 of less than 50 nM in a competition assay with labelled aprotinin for binding to human and/or mouse MTP-2.

19. A binder polypeptide according to clause 18, which has an IC50 of less than 20 nM in a competition assay with labelled aprotinin for binding to human MTP-2.

20. A binder polypeptide according to any preceding clause, which has an affinity (Kd) for human MTP-2 of less than 50 nM as determined by surface plasmon resonance.

21. A binder polypeptide according to any preceding clause, which has an affinity (Kd) for mouse MTP-2 of less than 50 nM as determined by surface plasmon resonance.

22. A binder polypeptide according to clause 21, wherein the Kd for mouse MTP-2 is within 50-fold of the Kd for human MTP-2.

23. A binder polypeptide according to any preceding clause, comprising an antibody heavy chain variable (VH) domain obtained by recombination of the set of germline vdj gene segments shown in Table G for any of NORI-001 to NORI-033 and/or an antibody light chain variable (VL) domain obtained by recombination of the set of germline vj gene segments shown in Table G for any of NORI-001 to NORI-033.

24. A binder polypeptide according to clause 23, wherein the VH domain and the VL domain are each obtained by recombination of the set of germline gene segments shown in Table G for NORI-001, NORI-002, NORI-003, NORI-004, NORI-005, NORI-006, NORI-007, NORI-008, NORI-009, NORI-010, NORI-011, NORI-012, NORI-013, NORI-014, NORI-015, NORI-016, NORI-017, NORI-018, NORI-019, NORI-020, NORI-021, NORI-022, NORI-023, NORI-024, NORI-025, NORI-026, NORI-027, NORI-028, NORI-029, NORI-030, NORI-031, NORI-032 or NORI-033.

25. A binder polypeptide according to any preceding clause, comprising an antibody heavy chain variable (VH) domain obtained by recombination of germline vdj gene segments:
IGHV3-9*01, IGHD4-17*01 and IGHJ6*02,
IGHV4-61*01, IGHD3-22*01 and IGHJ5*02,
IGHV3-49*05, IGHD3-9*01 and IGHJ4*02, or
IGHV3-13*01, IGHD3-10*01 and IGHJ3*02.

26. A binder polypeptide according to any preceding clause, comprising an antibody light chain variable (VL) domain obtained by recombination of germline vj gene segments:
IGLV2-8*01 and IGLJ2*01,
IGKV1D-33*01 and IGKJ5*01,
IGKV1D-33*01 and IGKJ4*01, and
IGKV3D-7*01 and IGKJ1*01.

27. A binder polypeptide according to any preceding clause, comprising a VH domain and a VL domain, the VH domain comprising a set of heavy chain complementarity determining regions (HCDRs) HCDR1, HCDR2 and HCDR3 and the VL domain comprising a set of light chain complementarity determining regions (LCDRs) LCDR1, LCDR2 and LCDR3, wherein the set of HCDRs is the set of HCDRs of any of NORI-001 to NORI-033 and/or wherein the set of LCDRs is the set of LCDRs of any of NORI-001 to NORI-033.

28. A binder polypeptide according to clause 27, wherein the set of HCDRs is the NORI-003 set of CDRs and the set of LCDRs is the NORI-003 set of LCDRs.

29. A binder polypeptide according to clause 27, wherein the set of HCDRs is the NORI-006 set of CDRs and the set of LCDRs is the NORI-006 set of LCDRs.

30. A binder polypeptide according to clause 27, wherein the set of HCDRs is the NORI-011 set of CDRs and the set of LCDRs is the NORI-011 set of LCDRs.

31. A binder polypeptide according to clause 27, wherein the set of HCDRs is the NORI-008 set of CDRs and the set of LCDRs is the NORI-008 set of LCDRs.

32. A binder polypeptide according to any preceding clause, comprising a VH domain having at least 90% amino acid sequence identity with the VH domain of any of NORI-001 to NORI-033 and/or a VL domain having at least 90% amino acid sequence identity with the VL domain of any of NORI-001 to NORI-033.

33. A binder polypeptide according to clause 32, comprising
a VH domain comprising the NORI-003 HCDRs and having at least 90% amino acid sequence identity with the VH domain of NORI-003, and
a VL domain comprising the NORI-003 LCDRs and having at least 90% amino acid sequence identity with the VL domain of NORI-003.

34. A binder polypeptide according to clause 33, comprising a NORI-003 antibody VH domain and a NORI-003 VL domain.

35. A binder polypeptide according to clause 32, comprising
a VH domain comprising the NORI-006 HCDRs and having at least 90% amino acid sequence identity with the VH domain of NORI-006, and a VL domain comprising the NORI-006 LCDRs and having at least 90% amino acid sequence identity with the VL domain of NORI-006.

36. A binder polypeptide according to clause 32, comprising a NORI-011 VH domain and a NORI-011 VL domain.

37. A binder polypeptide according to clause 36, comprising
a VH domain comprising the NORI-011 HCDRs and having at least 90% amino acid sequence identity with the VH domain of NORI-011, and
a VL domain comprising the NORI-011 LCDRs and having at least 90% amino acid sequence identity with the VL domain of NORI-011.

38. A binder polypeptide according to clause 32, comprising a NORI-008 VH domain and a NORI-008 VL domain.

39. A binder polypeptide according to clause 38, comprising
a VH domain comprising the NORI-008 HCDRs and having at least 90% amino acid sequence identity with the VH domain of NORI-008, and
a VL domain comprising the NORI-008 LCDRs and having at least 90% amino acid sequence identity with the VL domain of NORI-008.

38. A binder polypeptide according to clause 37, comprising a NORI-008 VH domain and a NORI-008 VL domain.

39. A binder polypeptide according to any of clauses 1 to 38, wherein the binder polypeptide comprises an antibody constant region.

40. A binder polypeptide according to clause 39, wherein the binder polypeptide is an IgG antibody.

41. A binder polypeptide according to clause 40, comprising a human IgG4PE constant region.

42. A binder polypeptide according to clause 41, comprising a NORI-003 antibody heavy chain and a NORI-003 antibody light chain.

43. A binder polypeptide according to clause 41, comprising a NORI-006 antibody heavy chain and a NORI-006 antibody light chain.

44. A binder polypeptide according to clause 41, comprising a NORI-011 antibody heavy chain and a NORI-011 antibody light chain.

45. A binder polypeptide according to clause 41, comprising a NORI-008 antibody heavy chain and a NORI-008 antibody light chain.

46. An isolated antibody comprising a VH domain and VL domain as defined in any of clauses 23 to 38.

47. An isolated antibody comprising a VH domain and VL domain which are the VH and VL domain of any of NORI-001 to NORI-033,
or comprising said VH and VL domain in which one or more non-germline residues of framework regions are reverted to germline.

48. An antibody according to clause 47, comprising the VH and VL domain of NORI-003 or comprising said VH and VL domain in which one or more non-germline residues of framework regions are reverted to germline.

49. An antibody according to clause 47, comprising the VH and VL domain of NORI-006 or comprising said VH and VL domain in which one or more non-germline residues of framework regions are reverted to germline.

50. An antibody according to clause 47, comprising the VH and VL domain of NORI-011 or comprising said VH and VL domain in which one or more non-germline residues of framework regions are reverted to germline.

51. An antibody according to clause 47, comprising the VH and VL domain of NORI-008 or comprising said VH and VL domain in which one or more non-germline residues of framework regions are reverted to germline.

52. An isolated antibody comprising the heavy chain and light chain of any of NORI-001 to NORI-033.

53. A monoclonal IgG antibody comprising:
   a NORI-003 antibody heavy chain and a NORI-003 antibody light chain,
   a NORI-006 antibody heavy chain and a NORI-006 antibody light chain,
   a NORI-011 antibody heavy chain and a NORI-011 antibody light chain, or
   a NORI-008 antibody heavy chain and a NORI-008 antibody light chain.

54. Nucleic acid encoding a binder polypeptide as defined in any of clauses 1 to 45 or an antibody as defined in any of clauses 46 or clause 53.

55. A host cell in vitro comprising nucleic acid as defined in clause 54.

56. A composition comprising a binder polypeptide as defined in any of clauses 1 to 45 or an antibody as defined in any of clauses 46 to 53, formulated with a pharmaceutically acceptable excipient.

57. A composition according to clause 56 which is for subcutaneous administration.

58. A composition comprising nucleic acid according to clause 54 which is for gene therapy in vivo.

59. A composition according to any of clauses 56 to 58 for use in treatment of the human or animal body by therapy.

60. A combination of medicaments comprising (i) an inhibitor of MTP-2 and (ii) an antagonist of a TGFβ superfamily ligand.

61. A combination according to clause 60, for use in treating iron overload and normalising erythropoiesis in a patient.

62. A method of treating iron overload and normalising erythropoiesis in a patient, comprising administering (i) an inhibitor of MTP-2 and (ii) an antagonist of a TGFβ family ligand to the patient, wherein (i) and (ii) are administered simultaneously or sequentially.

63. A combination according to clause 61 or a method according to clause 62, wherein the patient has beta-thalassaemia (optionally beta-thalassaemia major), MDS, Blackfan Diamond anaemia, Type 1 haemochromatosis or Type 3 haemochromatosis.

64. A combination or method according to any of clauses 60 to 63, wherein the antagonist is an activin II receptor ligand trap 65. A combination or method according to clause 64, wherein the antagonist is an activin IIB receptor Fc fusion protein 66. A combination or method according to clause 65, wherein the antagonist is luspatercept.

67. A combination or method according to clause 64, wherein the antagonist is an activin IIA receptor Fc fusion protein 68. A combination or method according to clause 67, wherein the antagonist is sotatercept.

69. A combination of medicaments comprising (i) an inhibitor of MTP-2 and (ii) erythropoietin.

70. A combination according to clause 69, for use in treating anaemia associated with iron overload in a patient.

71. A method of treating anaemia associated with iron overload in a patient, comprising administering (i) an inhibitor of MTP-2 and (ii) erythropoietin to the patient, wherein (i) and (ii) are administered simultaneously or sequentially.

72. A combination or method according to any above clause, wherein the inhibitor of MTP-2 is a binder polypeptide or an antibody as defined in any above clause.

72. A method of:

reducing absorption of dietary iron,
treating iron overload,
elevating expression of hepcidin from hepatocytes,
reducing anaemia caused by iron overload,
decreasing serum iron concentration and/on
decreasing transferrin iron saturation,
   in a patient, the method comprising administering a composition according to any of clauses 56 to 58 to the patient.

73. A method according to clause 72, wherein the patient has beta-thalassaemia (e.g., beta-thalassaemia major or inter-media), 5 q-MDS or RARS.

74. A method according to clause 72 or clause 73, wherein the method further comprises administering an antagonist of a TGFβ family ligand to the patient.

75. A method according to clause 74, wherein the antagonist is an activin II receptor ligand trap 76. A method according to clause 75, wherein the antagonist is an activin IIB receptor Fc fusion protein.

77. A method according to clause 76, wherein the antagonist is luspatercept.

78. A method according to clause 75, wherein the antagonist is an activin IIA receptor Fc fusion protein.

79. A method according to clause 76, wherein the antagonist is sotatercept.

80. A method according to clause 72 or clause 73, wherein the method further comprises administering an erythropoiesis stimulating agent to the patient, optionally wherein the erythropoiesis stimulating agent is erythropoietin.

81. A method according to clause 72 or clause 73, wherein the method comprises administering a further therapeutic agent to the patient to reduce iron overload, e.g., luspatercept.

82. A composition according to any of clauses 56 to 58 for use in a method as defined in any of clauses 72 to 81.

83. Use of a composition according to any of clauses 56 to 58 for the manufacture of a medicament for treatment of a patient, said treatment comprising a method as defined in any of clauses 72 to 81.

84. A therapeutic agent which reduces iron overload, for use in a method of:
reducing absorption of dietary iron,
treating iron overload,
elevating expression of hepcidin from hepatocytes,
reducing anaemia caused by iron overload,
decreasing serum iron concentration and/or
decreasing transferrin iron saturation,
   in a patient, the method comprising administering the therapeutic agent and a composition according to any of clauses 56 to 58 to the patient.

85. A therapeutic agent comprising erythropoietin (epo), for use in a method of stimulating erythropoesis in a patient, the method comprising administering the agent and a composition according to any of clauses 56 to 58 to the patient.

86. A therapeutic agent comprising an antagonist of a TGFβ family ligand, for use in a method of promoting erythrocyte maturation in a patient, the method comprising administering the agent and a composition according to any of clauses 56 to 58 to the patient.

87. A method according to any of clauses 74 to 81, a composition for use according to clause 82, use of a composition according to clause 83, a therapeutic agent for use according to any of clauses 84 to 86, wherein the method comprises administering the therapeutic agent and the composition to the patient separately and sequentially.

Matriptase-2 (MTP-2)

MTP-2 is a type II transmembrane trypsin-like serine protease belonging to the type II transmembrane serine protease (TTSP) family. The corresponding gene for MTP-2, TMPRSS6, is located at 22q12.3.

The canonical isoform of MTP-2, isoform 1, is an 811 amino acid protein with a molecular weight of 90 kDa. It has a conserved structure similar to closely related TTSP family members such as matriptase-1 and enteropeptidase that is comprised of a small N-terminal intracellular signal peptide, a signal anchor that functions as a single-pass transmembrane domain, followed by an extracellular structure consisting of a sea urchin sperm protein, enteropeptidase and agrin (SEA) domain, a trunk region containing two complement factor C1r/C1s, urchin embryonic growth factor and bone morphogenetic protein (CUB) domains and three low-density lipoprotein receptor (LDLR) class A repeats and a C-terminal serine protease (SP) domain. The SP domain possesses a highly conserved catalytic triad of amino acids, histidine (617), aspartic acid (668), and serine (762), which are necessary for enzymatic function. FIG. 2.

Like other TTSP members, the correct processing of MTP-2 into the membrane bound, enzymatically active form is a complicated process in which multiple disulphide bonds within the protein and the presence of additional endogenous proteins play a crucial role. MTP-2 is synthesised into the membrane of the endoplasmic reticulum and trafficked to the cell surface as an inactive zymogen, whereby it undergoes auto-cleavage at an arginine residue within a highly conserved activation motif between the CUB2 domain and the serine protease. The MTP-2 serine protease domain contains four essential disulphide bonds, one of which crucially links the domain to the membrane bound trunk.

The cleaved form of MTP-2 represents the active form and remains predominantly membrane bound where it can cleave other membrane bound targets on the cell surface. However, overexpression of MTP-2 in vitro has led to the discovery of a "shed" active form of MTP-2 found in the supernatants of cultured cells. Whether this shed form is part of natural MTP-2 biology with an in vivo function or simply a result of overexpression in cell-based systems remains unknown.

Amino acid sequences of MTP-2 are shown in Table S. For example, human MTP-2 has the amino acid sequence of Uniprot ID Q8IU80, comprising an N-terminal leader sequence and cytoplasmic domain, a transmembrane domain, and an extracellular domain (ECD). The ECD comprises amino acids 84-811 of the full-length protein. A fragment of MTP-2 comprising the ECD, amino acids 78-811, may be recombinantly produced and used in assays as described herein (e.g., in his-tagged form). Generation of MTP-2 for use in assays is detailed in Example 5.

A binder polypeptide according to the present invention may bind and inhibit any one or more, or all, of MTP-2 expressed on cell-surface, isolated MTP-2 ECD, and shed soluble MTP-2 ECD.

MTP-2 as referred to herein, unless otherwise indicated by context, may be human or non-human (e.g., mouse, rat or cynomolgus). Preferably, MTP-2 is human MTP-2.

Due to the complex processing of MTP-2 that involves the majority of the protein structure, mutations across the protein can result in a loss of function. In addition, there are known TMPRSS6 polymorphisms, such as r5855791, which can result in increased MTP-2 activity and more efficient inhibition of hepcidin. R576A mutation, mutates a critical arginine necessary for SP domain cleavage and full MTP-2 activation, therefore retaining the protein as an inactive zymogen. The S762A mutation mutates a critical serine residue within in the SP domain catalytic triad and completely abrogates activity. As such, the protein also remains as an inactive zymogen as auto-activity is needed for self-cleavage. The E114K mutant has been described in patients with non-functional MTP-2 expression. This mutation is present in the SEA domain and as such most likely prevent proper trafficking of the protein to the cell surface.

There are four known variants of MTP-2 that cover roughly 92% of the human population:

isoform 1 (27.4%);

the r5855791 SNP, which results in single amino acid change of valine to alanine at position 736 (27.2%);

a variant that possesses both the V736A and an additional K253E variation (25.9%); and a variant of K253E alone (11.4%).

Binder polypeptides will preferably bind all four such variants, thus being suitable to treat all or a majority of the human population by inhibiting MTP-2 variants expressed by the majority of the population. Thus, a binder polypeptide may bind human MTP-2 comprising sequence polymorphisms in which residue 253 is K or E and residue 736 is V or A.

There are 4 known isoforms of MTP-2. Isoform 1, known as the canonical isoform is the full length 811 amino acids, is expressed mainly in the testis. Isoform 2, is the predominant isoform of the liver and is missing 9 intracellular amino acids at the N-terminus (802 amino acids). This N-terminal region thought to be involved with the internalisation of membrane bound MTP-2 and is therefore internalised more slowly than isoform 1. Isoform 3 is also predominantly expressed in the testis along with isoform 1. It possesses the 9 N-terminal amino acids but utilises an alternative splice variant of exon 10 that drives the expression of a truncated form lacking the SP domain and is therefore functionally inactive. Isoform 4 displays the same exons as isoform 2 but also possesses an additional 22 amino acid exon between exon 16 and 17 that disrupts SP domain function and is also functionally inactive. Isoform 4 is seen to be expressed in tissues where isoform 2 is also expressed and due to their lack of function, Isoform 3 and 4 are therefore thought to be dominant negative regulators of isoforms 1 and 2. It has been shown the expression of isoform 3 or 4 can block isoform 2 mediated cleavage of HJV.

A binder polypeptide may bind at least the active isoforms 1 and 2. Optionally, it may bind isoform 3. Optionally it may bind isoform 4. A binder polypeptide optionally does not bind isoform 3. Optionally, it does not bind isoform 4. Absence of binding to the inactive isoform may be beneficial for a therapeutic molecule which is intended to inhibit MTP-2 activity. Binding to the serine protease catalytic domain of isoform 1 and/or isoform 2, and lack of binding to isoform 3 and/or isoform 4, is potentially advantageous.

Binding to MTP-2

As noted above, MTP-2 is a multi-domain protein and various mutations across the protein are known to result in a loss of function. As such, binder polypeptides may be generated which recognise binding sites in various domains and which inhibit enzymatic activity of the protein.

A binder polypeptide may bind to the serine protease catalytic domain of MTP-2. It may bind auto-activated MTP-2. It may bind the MTP-2 ECD. It may bind MTP-2 zymogen.

A binder polypeptide that binds to the serine protease catalytic domain may be identified as one which binds MTP-2 comprising said domain and does not bind MTP-2 lacking said domain. A "headless" variant of MTP-2 having a C-terminal truncation that deletes the serine protease domain, but still comprises the remainder of the ECD, may be constructed. Binding to the full-length MTP-2 ECD and absence of binding to the headless MTP-2 ECD indicates that the binder polypeptide recognises an epitope in the serine protease catalytic domain. Binding may be measured in an HTRF assay, or by surface plasmon resonance, example protocols for which are provided herein. Binding to the serine protease catalytic domain may also be identified in an enzymatic inhibition assay with MTP-2 ECD and headless MTP-2 ECD. A binder which binds the serine protease catalytic domain may exhibit dose-dependent binding to MTP-2 ECD in such as assay and not exhibit dose-dependent binding to headless MTP-2 ECD in said assay.

Binding to cell-surface expressed MTP-2 (e.g., expressed on HEK293 cells) may be detected by a fluorescence activated cell sorter (FACS).

A binder polypeptide may compete against aprotinin for binding to MTP-2 (e.g., MTP-2 ECD, e.g., to the serine protease catalytic domain thereof).

Competition between binder polypeptides may also be determined. For example, a binder polypeptide may compete with an antibody (e.g., IgG or scFv) comprising the VH and VL domains, or an IgG comprising the full heavy and light chains, of any of NORI-001 to NORI-033. It may for example compete with NORI-003 scFv. It may compete with NORI-006 scFv. It may compete with NORI-011 scFv. It may compete with NORI-008 scFv.

Competition between binder polypeptides indicates that they have epitopes in the same region of MTP-2, e.g., both may bind the same domain with an overlapping binding footprint.

IC50 may be calculated in a competition assay as a measure of the ability of a binder polypeptide to inhibit binding of the reference molecule (e.g., aprotinin or NORI antibody) to the MTP-2. A binder polypeptide may have an IC50 of less than 100 nM in such an assay. Optionally, IC50 is less than 50 nM, e.g., less than 20 nM.

For example, IC50 for competition with aprotinin may be determined in an HTRF competition assay with directly labelled aprotinin (e.g., aprotinin-647) at a concentration of 5 nM, binder polypeptide at a concentration of 0.3 nM and either human MTP-2 antigen at a concentration of 10 nM or mouse MTP-2 antigen at a concentration of 60 nM. Secondary antibody (e.g., AD0207) may be used at 1:1000 dilution. See Example 8, in which aprotinin was directly labelled using the 647 rapid labelling kit (Innova Biosciences—362-0010) according to the manufacturer's instructions. In order to determine IC50 for competition of a binder polypeptide against a reference NORI antibody, the reference antibody may be directly labelled (e.g., with 647 label) as above and the same protocol used, substituting the reference antibody for aprotinin.

Materials and Methods for HTRF Competition Assay

Antibodies were titrated into HTRF buffer (DPBS (Gibco—14190144) with 0.1% BSA (Sigma—A7906) and potassium fluoride 0.53M (Sigma—60240-250 G)) at 4× conc with a starting concentration of 200 nM. 5 µL/w of antibodies were added to 384-well white plates (Greiner—784904). Purified proteins of huMTP-2 and moMTP-2 were diluted into HTRF buffer (huMTP-2=40 nM and moMTP-2=240 nM) 4× final conc and plate 5 µL/w. Anti-MTP-2 mAb (NORI-037) in molgG1 backbone was then diluted to 1.2 nM 4× final conc with DELFIA Eu-N1 Rabbit Anti-Mouse-IgG antibody (AD0207) at a 1:1000 dilution 4× final conc in HTRF buffer. Finally, dilute 647-labelled Aprotinin (Sigma—A3428) in HTRF buffer to 20 nM 4× final conc and plate 5 µL/w. Incubate plates for 3 hours or more at RT in the dark. Read plate using HTRF 100 flashes protocol on the EnVision plate reader at 1H 2H and 3H. (Ex: 340 nm Em1: 620 nm Em2: 665 nm).

Affinity for Binding

A binder polypeptide may have an affinity ($K_D$) for human MTP-2 of less than 100 nM, less than 50 nM, less than 25 nM or less than 10 nM. A binder polypeptide may have an affinity (Kd) for mouse MTP-2 of less than 100 nM, less than 50 nM, less than 25 nM or less than 10 nM. A binder polypeptide may have an affinity ($K_D$) for rat MTP-2 of less than 100 nM, less than 50 nM, less than 25 nM or less than 10 nM. A binder polypeptide may have an affinity (Kd) for cynomolgus MTP-2 of less than 100 nM, less than 50 nM, less than 25 nM or less than 10 nM.

In some embodiments, $K_D$ for binding human MTP-2 may be less than 5 nM, e.g., less than 4 nM, less than 3 nM, less than 2 nM, less than 1 nM. or less than 0.1 nM. $K_D$ is optionally at least 0.001 nM, e.g., at least 0.005 nM.

A binder polypeptide may exhibit an affinity ($K_D$) which is in the range shown in Example 6, e.g., in Table K or Table W. $K_D$ of a binder polypeptide for binding MTP-2 may be the same as or less than that of any of NORI-001 to NORI-033 IgG or scFv (e.g., NORI-009 IgG). Optionally, the $K_D$ is the same as or less than that of aprotinin.

The affinity of a binder polypeptide for MTP-2 may be quantified in terms of the equilibrium dissociation constant KD, the ratio Ka/Kd of the association or on-rate (Ka) and the dissociation or off-rate (kd) of the binding interaction. KD, Ka and Kd for antigen binding can be measured using surface plasmon resonance (SPR). Example SPR procedure and conditions are set out in Example 6.

In brief, SPR may be performed at 25° C. by capturing the binder polypeptide on a chip for 60 sec at 10 µl/min at 1 µg/ml concentration (approximately between 35 and 50 RU may be captured), and MTP-2 (analyte) injected for 120 sec (association time) at 30 µl/min and dissociation monitored for 600 sec. Analyte may be injected at 100, 25, 6.25, 1.56 and 0 nM concentration. Sensorgrams for the binder polypeptide are generated, and data may be fitted to a 1:1 interaction model (e.g., using Biacore evaluation software with Rmax, ka, kd globally fitted, RI=0).

Quantification of affinity may be performed using SPR with the antigen-binding polypeptide arm in monovalent form, e.g., antibody Fab or Fv comprising the antigen binding site, or heterodimeric immunoglobulin (e.g., IgG) having a single antigen-binding arm for the antigen in question. Alternatively, it may be convenient to determine affinity for the antigen-binding polypeptide arm in bivalent form, for example IgG comprising homodimeric antigen-binding arms. SPR may comprise coating dimers of the antigen-binding polypeptide arm on to a biosensor chip (directly or indirectly), exposing the antigen-binding polypeptide arms to antigen in buffered solution at a range of concentrations, detecting binding, and calculating the equilibrium dissociation constant KD for the binding interaction. SPR may be performed at 25° C. A suitable buffered solution is 150 mM NaCl, 0.05% detergent (e.g., P20) and 3 mM EDTA, pH 7.6. HBS-P 1× (10 mM HEPES pH 7.4, 150 mM NaCl, 3 mM EDTA, 0.05% polysorbate 20 pH 7.6) with 2.5 mM $CaCl_2$. is an example buffer. The binding data can be fitted to a 1:1 model using standard algorithms, which may be inherent to the instrument used. A variety of SPR instruments are known, such as Biacore™, ProteOn XPR36™ (Bio-Rad®), and KinExA® (Sapidyne Instruments, Inc).

As noted elsewhere herein, isolated purified MTP-2 ECD may conveniently be used in assays and is a suitable analyte for SPR.

Cross-Reactivity

Regulatory bodies may require candidate therapeutic molecules to have demonstrated therapeutic efficacy in laboratory animals before they advance to human clinical trials. Examples of mouse models of beta-thalassaemia and assessment of binder polypeptides in wild type mice is illustrated herein. To enable testing of binder polypeptides in such animal models, it is desirable for the binder to be cross-reactive with the corresponding antigen from one or more non-human mammals. Thus, it may bind non-human MTP-2 as well as human MTP-2.

One way to quantify the extent of species cross-reactivity of an antigen-binding molecule (or, more precisely, of its antigen binding site) is as the fold-difference in its affinity for antigen or one species compared with antigen of another species, e.g., fold difference in affinity for human antigen vs mouse antigen. Affinity may be quantified as KD, referring to the equilibrium dissociation constant of the binding of the antigen to the antigen-binding molecule. KD may be determined by SPR as described elsewhere herein.

A species cross-reactive binding molecule may have a fold-difference in affinity for binding human and non-human antigen that is 100-fold or less, 50-fold or less, 30-fold or less, 25-fold or less, 20-fold or less, 15-fold or less, 10-fold or less or 5-fold or less. To put it another way, the KD of binding the extracellular domain of the human antigen may be within 30-fold, 25-fold, 20-fold, 15-fold, 10-fold or 5-fold of the KD of binding the extracellular domain of the non-human antigen.

Preferably, the binding affinities of human and non-human antigen are within a range of 10-fold or less, more preferably within 5-fold or within 2-fold. KD for binding non-human MTP-2, e.g., as determined by surface plasmon resonance, may be up to 10-fold (preferably up to 5-fold or up to 2-fold) greater or up to 10-fold lower (preferably up to 5-fold or up to 2-fold lower) than the Kd for binding human MTP-2.

Binding molecules can also be considered species cross-reactive if the KD for binding antigen of both species meets a threshold value, e.g., if the KD of binding human antigen and the KD of binding non-human antigen are both 10 mM or less, preferably 5 mM or less, more preferably 1 mM or less. The KD may be 100 nM or less, 50 nM or less, 25 nM or less, 10 nM or less, 5 nM or less, 2 nM or less, or 1 nM or less.

Cross-reactivity can also be identified by the ability of a binder polypeptide to recognise MTP-2 of multiple species expressed on cells, e.g., using FACS. HTRF may also be used to determine binding and cross-reactivity with MTP-2 of multiple species.

A binder polypeptide may have a measurable capacity to block enzymatic activity via fluorescent readout using MTP-2 substrate from multiple species, (e.g., one or more, or all, of human and mouse, rat and cynomolgus MTP-2). It may exhibit dose-dependent inhibition of MTP-2 catalytic activity in an assay described herein with human and non-human (e.g., mouse, rat or cynomolgus) MTP-2.

While species cross-reactivity for binding antigen of different species may be advantageous, selectivity of the binder for MTP-2 is nevertheless desirable to avoid unwanted side effects. Thus, within the body, MTP-2 is preferably the only antigen bound by the antigen-binding site of the binder polypeptide. Notwithstanding this, a binder polypeptide may optionally be engineered to comprise further binding sites, and an antibody comprising an antibody constant region may for example optionally bind one or more Fc receptors.

A binder polypeptide optionally does not bind MTP-1 (e.g., human MTP-1). Optionally it does not bind MTP-3 (e.g., human MTP-3). Optionally, it does not bind other members of the type II transmembrane serine protease family.

Inhibition of MTP-2

MTP-2 is predominantly expressed on liver cells and has a main role in iron metabolism by modulating the expression of hepcidin from hepatocytes. It is now well established that hepcidin expression, the main regulator of iron homeostasis, is controlled by the bone morphogenetic protein (BMP) growth factors, which bind to type I and II BMP receptors present on hepatocyte cells and induce the BMP/sons of mothers against decapentaplegic (SMAD) signalling pathway. Phosphorylation of a Smad1, 5, 8/Smad4 complex downstream of the BMP receptors increases expression of the HAMP gene coding for hepcidin and increases secretion of hepcidin. Hepcidin reduces blood iron levels through binding to the iron transporter ferroportin present on duodenal enterocytes, macrophages, and hepatocytes, inducing internalisation and degradation and thus decreasing the amount of iron entering the blood. MTP-2 is thought to negatively regulate hepcidin expression through selectively cleaving members of the BMPR complex on the hepatocyte cell surface and therefore silencing BMP/SMAD signalling. One proposed enzymatic target for MTP-2 is haemojuvelin (HJV), a coreceptor of the BMPR complex, which is necessary for maximum BMP/SMAD signalling. However, although studies have shown MTP-2 is able to cleave HJV and generate a specific cleavage product, MTP-2 mask mice show a conflicting decrease in expression of membrane bound HJV while TMPRSS6 KO mice show increased levels of cleaved HJV. More recently, studies have shown that MTP-2 most likely cleaves multiple members of the BMPR complex to inhibit hepcidin expression.

According to tissue wide scans for TMPRSS6 mRNA expression, there are also small levels of MTP-2 expression in the testis, however, the role of MTP-2 here is largely unknown. Because of the localised expression of MTP-2, both TMPRSS6 KO mice and humans with loss-of-function MTP-2 mutations show a phenotype whereby iron levels are hugely elevated and have no additional side-effects, suggesting additional roles to iron regulation are limited and therefore of minor concern with respect to anti-MTP-2 therapy.

The present invention thus proposes to inhibit MTP-2 and thereby prevent or reduce cleavage of its downstream substrates, resulting in reduction of MTP-2 inhibition on hepcidin expression.

Inhibition of MTP-2 refers to inhibition of the enzymatic activity of MTP-2. MTP-2 is a serine protease, and an inhibitor may be one which inhibits mature active MTP-2 catalysis of serine protease cleavage of its substrate and/or which inhibits auto-activation of MTP-2 zymogen by catalysis of serine protease cleavage.

In various embodiments, a binder polypeptide may bind to the serine protease catalytic domain of MTP-2. The serine protease catalytic domain contains the enzymatic active site of MTP-2. Inhibition may result from steric hindrance of enzyme-substrate interaction, caused by a binder polypeptide that is bound to MTP-2 and partially or fully masks the enzyme active site, thereby reducing substrate binding. Inhibition may alternatively or additionally result from a binder polypeptide inducing a de-activating conformational change in the serine protease catalytic domain, or biasing the serine protease catalytic domain towards an inactive conformation, whereby its enzymatic activity is reduced. Regardless of the molecular mechanism of inhibition, the ability of a binder polypeptide to inhibit MTP-2 serine protease activity may be functionally determined in an enzymatic assay.

Described herein are an in vitro assays for inhibition of serine protease cleavage of a substrate of MTP-2 to generate a detectable product. These include enzymatic assay with purified MTP-2 ECD and fluorescent substrate, and enzymatic assay with cell-surface expressed MTP-2 and fluorescent substrate. Each of these assays determines inhibition of MTP-2 cleavage of its substrate. The fluorescent substrate Boc-Gln-Gly-Arg-AMC may be used, e.g., at 50 μM final concentration. A binder polypeptide which is an inhibitor of MTP-2 enzymatic activity may be identified by dose-dependent inhibition of MTP-2 serine protease activity in such an enzymatic assay.

In one embodiment, a binder polypeptide has an IC50 less than 100 nM in an enzymatic assay against human MTP-2 extracellular domain with an activity rate of 0.075 U/μl in the presence of 50 μM Boc-Gln-Gly-Arg-AMC fluorescent substrate. The IC50 may be less than 80 nM, less than 60 nM, less than 50 nM, less than 40 nM, less than 30 nM, less than 25 nM, less than 20 nM, less than 15 nM or less than 10 nM. The IC50 is optionally at least 0.01 nM, at least 0.1 nM, at least 1 nM, at least 2 nM, at least 3 nM or at least 5 nM.

In one embodiment, a binder polypeptide has an IC50 less than 100 nM in an enzymatic assay against non-human (e.g., mouse, rat or cynomolgus) MTP-2 extracellular domain with an activity rate of 0.075 U/μl in the presence of 50 μM Boc-Gln-Gly-Arg-AMC fluorescent substrate. The IC50 may be less than 80 nM, less than 60 nM, less than 50 nM, less than 40 nM, less than 30 nM, less than 25 nM, less than 20 nM, less than 15 nM or less than 10 nM. The IC50 is optionally at least 0.01 nM, at least 0.1 nM, at least 1 nM, at least 2 nM, at least 3 nM or at least 5 nM.

As noted above, preferably a binder polypeptide is species cross-reactive and is thus inhibitory against MTP-2 from more than one species, e.g., against human and non-human (e.g., mouse, rat or cynomolgus) MTP-2. Parameters for quantifying cross-reactivity in the assay are discussed elsewhere herein.

In one embodiment, a binder polypeptide exhibits dose-dependent inhibition of MTP-2 serine protease activity in an enzymatic assay with HEK293 cell surface expressed human MTP-2 and 50 μM final concentration fluorescent MTP-2 substrate. It may have an IC50 less than 100 nM in said assay. The IC50 may be less than 80 nM, less than 60 nM, less than 50 nM, less than 40 nM, less than 30 nM, less than 25 nM, less than 20 nM, less than 15 nM or less than 10 nM. The IC50 is optionally at least 0.01 nM, at least 0.1 nM, at least 1 nM, at least 2 nM, at least 3 nM or at least 5 nM.

Inhibition of the enzymatic activity of MTP-2 may further be detected in hepatocytes. For example, a binder polypeptide that inhibits MTP-2 may increase hepcidin expression (with or without bmp stimulation) in a hepatoma cell line, measurable as an increase in hamp mRNA relative to control.

Similar readouts may be obtained from in vivo assays. In mice to whom a binder polypeptide is administered, inhibition of MTP-2 enzymatic activity may result in an increase in hamp mRNA, reduction in serum iron and reduction in transferrin saturation (TSAT). A binder polypeptide may be administered to a wild type (e.g., at 10 mg/kg) to measure these effects. It may produce at least a 2-fold increase in hamp mRNA in hepatocytes within 24 hours following dosing, and this increase may be sustained at 3 days and preferably at 21 days after dosing (e.g., following intraperitoneal administration of a single 10 mg/kg dose). A binder polypeptide may produce a decrease in serum iron concentration in the mouse. Again this may be detectable within 24 hours, and is preferably sustained at 3 days and preferably at 21 days after dosing. Example experiments and protocols for measuring hamp mRNA, quantifying serum iron and TSAT are set out in the Examples.

Binder Polypeptides

Binder polypeptides according to the present invention are polypeptide molecules with an ability to specifically and inhibit bind MTP-2.

Many classes of binder polypeptides are known in the art, including classical IgG antibodies and other binding proteins based on immunoglobulin domains (see Binz, Amstutz & Pluckthun, Nature Biotechnology 23(10):1257 2005. Non-immunoglobulin binding molecules are also known, and binding loops may be engineered into other polypeptide scaffolds such as fibronectin.

Preferably, a binder polypeptide of the present invention comprises an immunoglobulin domain in which a binding site for MTP-2 is formed by loop regions of the immunoglobulin domain. Preferred embodiments of binder polypeptides are antibodies.

Antibodies according to the present invention are immunoglobulins or molecules comprising immunoglobulin domains, whether natural or partly or wholly synthetically produced. Antibodies may be IgG, IgM, IgA, IgD or IgE molecules or antigen-specific antibody fragments thereof (including, but not limited to, a Fab, F(ab')2, Fv, disulphide linked Fv, scFv, single domain antibody, closed conformation multispecific antibody, disulphide-linked scfv, diabody), whether derived from any species that naturally produces an antibody, or created by recombinant DNA technology; whether isolated from serum, B-cells, hybridomas, transfectomas, yeast or bacteria. Antibodies can be humanised using routine technology. The term antibody covers any polypeptide or protein comprising an antibody antigen-binding site. An antigen-binding site (paratope) is the part of an antibody that binds to and is complementary to the epitope of its target antigen (MTP-2).

The term "epitope" refers to a region of an antigen that is bound by an antibody. Epitopes may be defined as structural or functional. Functional epitopes are generally a subset of the structural epitopes and have those residues that directly contribute to the affinity of the interaction. Epitopes may also be conformational, that is, composed of nonlinear amino acids. In certain embodiments, epitopes may include determinants that are chemically active surface groupings of molecules such as amino acids, sugar side chains, phosphoryl groups, or sulfonyl groups, and, in certain embodiments, may have specific three-dimensional structural characteristics, and/or specific charge characteristics.

The antigen binding site is a polypeptide or domain that comprises one or more CDRs of an antibody and is capable of binding the antigen. For example, the polypeptide comprises a CDR3 (e.g., HCDR3). For example the polypeptide comprises CDRs 1 and 2 (e.g., HCDR1 and 2) or CDRs 1-3 of a variable domain of an antibody (e.g., HCDRs1-3).

An antibody antigen-binding site may be provided by one or more antibody variable domains. In an example, the antibody binding site is provided by a single variable domain, e.g., a heavy chain variable domain (VH domain) or a light chain variable domain (VL domain). In another example, the binding site comprises a VH/VL pair or two or more of such pairs. Thus, an antibody antigen-binding site may comprise a VH and a VL.

The antibody may be a whole immunoglobulin, including constant regions, or may be an antibody fragment. An antibody fragment is a portion of an intact antibody, for example comprising the antigen binding and/or variable region of the intact antibody. Examples of antibody fragments include:

(i) a Fab fragment, a monovalent fragment consisting of the VL, VH, CL and CH1 domains; (ii) a F(ab')2 fragment, a bivalent fragment including two Fab fragments linked by a disulfide bridge at the hinge region; (iii) an Fd fragment consisting of the VH and CH1 domains;

(iv) an Fv fragment consisting of the VL and VH domains of a single arm of an antibody, (v) a dAb fragment (Ward et al., (1989) Nature 341:544-546; which is incorporated by reference herein in its entirety), which consists of a VH or VL domain; and (vi) an isolated complementarity determining region (CDR) that retains specific antigen-binding functionality.

Further examples of antibodies are H2 antibodies that comprise a dimer of a heavy chain (5'-VH-(optional hinge)-CH2-CH3-3') and are devoid of a light chain.

Single-chain antibodies (e.g., scFv) are a commonly used fragment. Multispecific antibodies may be formed from antibody fragments. An antibody of the invention may employ any such format, as appropriate.

Optionally, binder polypeptides, or antibody immunoglobulin domains thereof, may be fused or conjugated to additional polypeptide sequences and/or to labels, tags, toxins or other molecules. Binder polypeptides may be fused or conjugated to one or more different antigen binding regions, providing a molecule that is able to bind a second antigen in addition to MTP-2. For example, an antibody of the present invention may be a multispecific antibody, e.g., a bispecific antibody, comprising (i) an antibody antigen binding site for MTP-2 and (ii) a further antigen binding site (optionally an antibody antigen binding site, as described herein) which recognises another antigen.

An antibody normally comprises an antibody VH and/or VL domain. Isolated VH and VL domains of antibodies are also part of the invention. The antibody variable domains are the portions of the light and heavy chains of antibodies that include amino acid sequences of complementarity determining regions (CDRs; ie., CDR1, CDR2, and CDR3), and framework regions (FRs). Thus, within each of the VH and VL domains are CDRs and FRs. A VH domain comprises a set of HCDRs, and a VL domain comprises a set of LCDRs. VH refers to the variable domain of the heavy chain. VL refers to the variable domain of the light chain. Each VH and VL is typically composed of three CDRs and four FRs, arranged from amino-terminus to carboxy-terminus in the following order: FR1, CDR1, FR2, CDR2, FR3, CDR3, FR4. According to the methods used in this invention, the amino acid positions assigned to CDRs and FRs may be defined according to Kabat (Sequences of Proteins of Immunological Interest (National Institutes of Health, Bethesda, Md., 1987 and 1991)) or according to IMGT nomenclature.

An antibody may comprise an antibody VH domain comprising a VH CDR1, CDR2 and CDR3 and a framework. It may alternatively or also comprise an antibody VL domain comprising a VL CDR1, CDR2 and CDR3 and a framework. Examples of antibody VH and VL domains and CDRs according to the present invention are as listed in Table S. All VH and VL sequences, CDR sequences, sets of CDRs and sets of HCDRs and sets of LCDRs disclosed herein represent aspects and embodiments of the invention. As described herein, a "set of CDRs" comprises CDR1, CDR2 and CDR3. Thus, a set of HCDRs refers to HCDR1, HCDR2 and HCDR3, and a set of LCDRs refers to LCDR1, LCDR2 and LCDR3. Unless otherwise stated, a "set of CDRs" includes HCDRs and LCDRs.

As described in more detail in the Examples, we isolated and characterised antibodies of particular interest, designated NORI-001, NORI-002, NORI-003, NORI-004, NORI-005, NORI-006, NORI-007, NORI-008, NORI-009, NORI-010, NORI-011, NORI-012, NORI-013, NORI-014, NORI-015, NORI-016, NORI-017, NORI-018, NORI-019, NORI-020, NORI-021, NORI-022, NORI-023, NORI-024, NORI-025, NORI-026, NORI-027, NORI-028, NORI-029, NORI-030, NORI-031, NORI-032 and NORI-033 ("NORI-001 to NORI-033").

In various aspects of the invention, unless context dictates otherwise, antibodies may be selected from any of these antibodies, or from the sub-set of NORI-003, NORI-006, NORI-011 or NORI-008.

The present invention encompasses anti-MTP-2 antibodies having the VH and/or VL domain sequences of all antibodies shown in the appended sequence listing and/or in the drawings, as well as antibodies comprising the HCDRs and/or LCDRs of those antibodies, and optionally having the full heavy chain and/or full light chain amino acid sequence of any anti-MTP-2 antibody disclosed herein.

CDR sequences may be defined by IMGT or by another method such as Kabat. Unless otherwise specified, references to residues in variable domains or to CDRs or framework regions refer to the IMGT definitions.

Where an antibody VH domain or VL domain comprises one or more residues in a framework region which differ from the germline gene segment from which it was obtained by recombination, the non-germline residue may be retained or may be mutated to a different residue, e.g., it may be reverted to the germline residue. Corresponding germline gene segments may be identified as the gene segment to which the sequence of the variable domain is most closely aligned, and the germline gene segments corresponding to each of NORI-001 to NORI-033 VH and VL domains are shown in Table G herein.

An antibody according to the present invention may comprise one or more CDRs as described herein, e.g. a CDR3, and optionally also a CDR1 and CDR2 to form a set of CDRs. The CDR or set of CDRs may be a CDR or set of CDRs of any of NORI-001 to NORI-033.

The invention provides antibodies comprising an HCDR1, HCDR2 and/or HCDR3 of any of antibodies NORI-001 to NORI-033 and/or an LCDR1, LCDR2 and/or LCDR3 of any of these antibodies, e.g. a set of CDRs. The antibody may comprise a set of VH CDRs of one of these antibodies. Optionally it may also comprise a set of VL CDRs of one of these antibodies, and the VL CDRs may be from the same or a different antibody as the VH CDRs.

A VH domain comprising a disclosed set of HCDRs, and/or a VL domain comprising a disclosed set of LCDRs, are also provided by the invention.

Typically, a VH domain is paired with a VL domain to provide an antibody antigen-binding site, although as discussed further below a VH or VL domain alone may be used to bind antigen. The NORI-003 VH domain may be paired with the NORI-003 VL domain, so that an antibody antigen-binding site is formed comprising both the NORI-003 VH and VL domains. Analogous embodiments are provided for the other VH and VL domains disclosed herein. In other embodiments, the NORI-003 VH is paired with a VL domain other than the NORI-003 VL. Light-chain promiscuity is well established in the art. Again, analogous embodiments are provided by the invention for the other VH and VL domains disclosed herein.

Thus, the VH of any of antibodies NORI-001 to NORI-033 may be paired with the VL of any of antibodies NORI-001 to NORI-033.

An antibody may comprise one or more CDRs, e.g. a set of CDRs, within an antibody framework. The framework regions may be of human germline gene segment sequences. Thus, the antibody may be a human antibody having a VH domain comprising a set of HCDRs in a human germline framework. Normally the antibody also has a VL domain comprising a set of LCDRs, e.g. in a human germline framework. An antibody "gene segment", e.g., a VH gene segment, D gene segment, or JH gene segment refers to oligonucleotide having a nucleic acid sequence from which that portion of an antibody is derived, e.g., a VH gene segment is an oligonucleotide comprising a nucleic acid sequence that corresponds to a polypeptide VH domain from FR1 to part of CDR3. Human V, D and J gene segments recombine to generate the VH domain, and human V and J segments recombine to generate the VL domain. The D domain or region refers to the diversity domain or region of an antibody chain. J domain or region refers to the joining domain or region of an antibody chain. Somatic hypermutation may result in an antibody VH or VL domain having framework regions that do not exactly match or align with the corresponding gene segments, but sequence alignment can be used to identify the closest gene segments and thus identify from which particular combination of gene segments a particular VH or VL domain is derived. When aligning antibody sequences with gene segments, the antibody amino acid sequence may be aligned with the amino acid sequence encoded by the gene segment, or the antibody nucleotide sequence may be aligned directly with the nucleotide sequence of the gene segment.

An antibody of the invention may be a human antibody or a chimaeric antibody comprising human variable regions and non-human (e.g., mouse) constant regions. The antibody of the invention for example has human variable regions, and optionally also has human constant regions.

Thus, antibodies optionally include constant regions or parts thereof, e.g., human antibody constant regions or parts thereof. For example, a VL domain may be attached at its C-terminal end to antibody light chain kappa or lambda constant domains. Similarly, an antibody VH domain may be attached at its C-terminal end to all or part (e.g. a CH1 domain or Fc region) of an immunoglobulin heavy chain constant region derived from any antibody isotype, e.g. IgG, IgA, IgE and IgM and any of the isotype sub-classes, such as IgG1 or IgG4.

Examples of human heavy chain constant regions are shown in Table S.

Constant regions of antibodies of the invention may alternatively be non-human constant regions. For example, when antibodies are generated in transgenic animals (examples of which are described elsewhere herein), chimaeric antibodies may be produced comprising human variable regions and non-human (host animal) constant regions. Some transgenic animals generate fully human antibodies. Others have been engineered to generate antibodies comprising chimaeric heavy chains and fully human light chains. Where antibodies comprise one or more non-human constant regions, these may be replaced with human constant regions to provide antibodies more suitable for administration to humans as therapeutic compositions, as their immunogenicity is thereby reduced.

Digestion of antibodies with the enzyme papain, results in two identical antigen-binding fragments, known also as "Fab" fragments, and a "Fc" fragment, having no antigen-binding activity but having the ability to crystallize. "Fab" when used herein refers to a fragment of an antibody that includes one constant and one variable domain of each of the heavy and light chains. The term "Fc region" herein is used to define a C-terminal region of an immunoglobulin heavy chain, including native-sequence Fc regions and variant Fc regions. The "Fc fragment" refers to the carboxy-terminal portions of both H chains held together by disulfides. The effector functions of antibodies are determined by sequences in the Fc region, the region which is also recognised by Fc receptors (FcR) found on certain types of cells. Digestion of antibodies with the enzyme pepsin, results in a F(ab')2 fragment in which the two arms of the antibody molecule remain linked and comprise two-antigen binding sites. The F(ab')2 fragment has the ability to crosslink antigen.

"Fv" when used herein refers to the minimum fragment of an antibody that retains both antigen-recognition and antigen-binding sites. This region consists of a dimer of one heavy and one light chain variable domain in tight, non-covalent or covalent association. It is in this configuration that the three CDRs of each variable domain interact to define an antigen-binding site on the surface of the VH-VL dimer. Collectively, the six CDRs confer antigen-binding specificity to the antibody. However, even a single variable domain (or half of an Fv comprising only three CDRs specific for an antigen) has the ability to recognise and bind antigen, although at a lower affinity than the entire binding site.

Antibodies disclosed herein may be modified to increase or decrease serum half-life. In one embodiment, one or more of the following mutations: T252L, T254S or T256F are introduced to increase biological half-life of the antibody. Biological half-life can also be increased by altering the heavy chain constant region $CH_1$ domain or CL region to contain a salvage receptor binding epitope taken from two loops of a $CH_2$ domain of an Fc region of an IgG, as described in U.S. Pat. Nos. 5,869,046 and 6,121,022, the modifications described therein are incorporated herein by reference. In another embodiment, the Fc hinge region of an antibody or antigen-binding fragment of the invention is mutated to decrease the biological half-life of the antibody or fragment. One or more amino acid mutations are introduced into the $CH_2$—$CH_3$ domain interface region of the Fc-hinge fragment such that the antibody or fragment has impaired Staphylococcal protein A (SpA) binding relative to native Fc-hinge domain SpA binding. Other methods of increasing serum half-life are known to those skilled in the art. Thus, in one embodiment, the antibody or fragment is PEGylated. In another embodiment, the antibody or fragment is fused to an albumin-biding domain, e.g. an albumin binding single domain antibody (dAb). In another embodiment, the antibody or fragment is PASylated (i.e. genetic fusion of polypeptide sequences composed of PAS (XL-Protein GmbH) which forms uncharged random coil structures with large hydrodynamic volume). In another embodiment, the antibody or fragment is XTENylated®/ rPEGylated (i.e. genetic fusion of non-exact repeat peptide sequence (Amunix, Versartis) to the therapeutic peptide). In another embodiment, the antibody or fragment is ELPylated (i.e. genetic fusion to ELP repeat sequence (PhaseBio)).

These various half-life extending fusions are described in more detail in Strohl, BioDrugs (2015) 29:215-239, which fusions, e.g. in Tables 2 and 6, are incorporated herein by reference.

Antibody Constant Regions

As discussed above, antibodies can be provided in various isotypes and with different constant regions. The Fc region of antibodies is recognised by Fc receptors and determines the ability of the antibody to mediate cellular effector functions, including antibody-dependent cell-mediated cyto-toxicity (ADCC) activity, complement dependent cytotox-icity (CDC) activity and antibody-dependent cell phagocy-tosis (ADCP) activity. These cellular effector functions involve recruitment of cells bearing Fc receptors to the site of the target cells, resulting in killing of the antibody-bound cell.

In the context of the present invention it is desirable to avoid cellular effector functions such as ADCC, ADCP and/or CDC. Therefore, antibodies according to the present invention may lack Fc effector function, for example they may contain Fc regions that do not mediate ADCC, ADCP and/or CDC, or they may lack Fc regions or lack antibody constant regions entirely. An antibody may have a constant region which is effector null.

An antibody may have a heavy chain constant region that binds one or more types of Fc receptor but does not induce cellular effector functions, i.e., does not mediate ADCC, CDC or ADCP activity. Such a constant region may be unable to bind the particular Fc receptor(s) responsible for triggering ADCC, CDC or ADCP activity.

An antibody may have a heavy chain constant region that does not bind Fcγ receptors, for example the constant region may comprise a Leu235Glu mutation (i.e., where the wild type leucine residue is mutated to a glutamic acid residue), which may be referred to as an "E" mutation, e.g., IgG4-E. Another optional mutation for a heavy chain constant region is Ser228Pro ("P" mutation), which increases stability by reducing Fab arm exchange. A heavy chain constant region may be an IgG4 comprising both the Leu235Glu mutation and the Ser228Pro mutation. This "IgG4-PE" heavy chain constant region is effector null. An alternative effector null human constant region is a disabled IgG1.

IgG4PE is a preferred antibody isotype for the present invention. A binder polypeptide may be an IgG4PE antibody comprising the sequence of an IgG4PE constant region shown in Table S.

Antibody constant regions may be engineered to have an extended half life in vivo. Examples include "YTE" muta-tions and other half-life extending mutations (Dall'Acqua, Kiener & Wu, JBC 281(33):23514-23524 2006 and WO02/060919, incorporated by reference herein). The triple muta-tion YTE is a substitution of 3 amino acids in the IgG CH2 domain, these mutations providing tyrosine at residue 252, threonine at residue 254 and glutamic acid at residue 256, numbered according to the EU index of Kabat. As described in the referenced publications, the YTE modification increases the half-life of the antibody compared with the half-life of a corresponding antibody having a human CH2 wild type domain. To provide an increased duration of efficacy in vivo, antibodies of the present invention may include antibody constant regions (e.g., IgG constant regions, e.g., IgG CH2 domains) that have one or more mutations that increase the half life of the antibody com-pared with the corresponding wild type human constant region (e.g., IgG, e.g., IgG CH2 domain). Half-life may be determined by standard methods, such as are described in WO02/060919.

Suitable antibody constant regions may be selected according to the genotype of the patient to be treated. For example, as described in US20160319017, a method of increasing erythropoiesis in a human patient may comprise administering a binder (e.g., antibody) that binds human MTP-2 encoded by a TMPRSS6 nucleotide sequence com-prising a SNP selected from the group consisting of:
r5855791, r52543519, rs2235324 and r51421312;
the binder comprising a constant region selected from the group consisting of:
(a) a human gamma-4 heavy chain constant region that comprises a Leu at position 189 shown in SEQ ID NO: 73 or an Arg at position 289 shown in SEQ ID NO: 73 of US20160319017; and
(b) a human gamma-1 heavy chain constant region that comprises an Asp corresponding to position 204 of SEQ ID NO: 42 of US20160319017 or a Leu corresponding to position 206 of SEQ ID NO: 42 of US20160319017; and wherein
(i) the human subject comprises a TMPRSS6 nucleotide sequence comprising said selected SNP; and
(ii) the human patient comprises a constant region gene segment encoding said selected constant region; or the human patient expresses antibodies comprising said selected constant region.

May be an antibody as described in US20160319017 Comprise a constant region as described in said publication and/or be used to treat a patient comprising a TMPRSS6 nucleotide sequence polymorphism as described in said publication.

Further example constant regions are shown in Table S.

Generating and Modifying Binder Polypeptides

Methods for identifying and preparing binder polypep-tides, including antibodies, are well known in the art.

For example, antibodies may be generated using labora-tory animals such as mice, including transgenic mice (eg, the Kymouse™, Velocimouse®, Omnimouse®, Xenomouse®, HuMab Mouse® or MeMo Mouse®), rats (e.g., the Omni-rat®), camelids, sharks, rabbits, chickens or other non-human animals immunised with MTP-2 or a fragment thereof (e.g., recombinant MTP-2 ECD) or its encoding nucleic acid, followed optionally by humanisation of the constant regions and/or variable regions to produce human or humanised antibodies. In an example, display technolo-gies can be used, such as yeast, phage or ribosome display, as will be apparent to the skilled person. Standard affinity maturation, e.g., using a display technology, can be per-formed in a further step after isolation of an antibody lead from a transgenic animal, phage display library or other library. Representative examples of suitable technologies are described in US20120093818 (Amgen, Inc), which is incor-porated by reference herein in its entirety, eg, the methods set out in paragraphs [0309] to [0346].

There are many reasons why it may be desirable to create variants of a binder, which include optimising a polypeptide sequence for large-scale manufacturing, facilitating purifi-cation, enhancing stability or improving suitability for inclu-sion in a desired pharmaceutical formulation. Protein engi-neering work can be performed at one or more target residues in the antibody sequence, e.g., to substituting one amino acid with an alternative amino acid (optionally, generating variants containing all naturally occurring amino acids at this position, with the possible exception of Cys and Met), and monitoring the impact on function and expression to determine the best substitution. It is in some instances undesirable to substitute a residue with Cys or Met, or to introduce these residues into a sequence, as to do so may generate difficulties in manufacturing—for instance through the formation of new intramolecular or intermolecular cysteine-cysteine bonds. Where a lead candidate has been selected and is being optimised for manufacturing and clinical development, it will generally be desirable to change its antigen-binding properties as little as possible, or at least to retain the affinity and potency of the parent molecule. However, variants may also be generated in order to modulate key antibody characteristics such as affinity, cross-reactivity or neutralising potency.

An antibody may comprise a set of H and/or L CDRs of any of the disclosed antibodies with one or more amino acid mutations within the disclosed set of H and/or L CDRs. The mutation may be an amino acid substitution, deletion or insertion. Thus for example there may be one or more amino acid substitutions within the disclosed set of H and/or L CDRs. For example, there may be up to 12, 11, 10, 9, 8, 7, 6, 5, 4, 3 or 2 mutations e.g. substitutions, within the set of H and/or L CDRs. For example, there may be up to 6, 5, 4, 3 or 2 mutations, e.g. substitutions, in HCDR3 and/or there may be up to 6, 5, 4, 3, or 2 mutations, e.g. substitutions, in LCDR3. An antibody may comprise the set of HCDRs, LCDRs or a set of 6 (H and L) CDRs shown for any NORI antibody herein or may comprise that set of CDRs with one or two conservative substitutions.

One or more amino acid mutations may optionally be made in framework regions of an antibody VH or VL domain disclosed herein. For example, one or more residues that differ from the corresponding human germline segment sequence may be reverted to germline. Human germline gene segment sequences corresponding to VH and VL domains of example anti-MTP-2 antibodies are indicated in Table G.

An antibody may comprise a VH domain that has at least 60, 70, 80, 85, 90, 95, 98 or 99% amino acid sequence identity with a VH domain of any of the antibodies shown in the appended sequence listing, and/or comprising a VL domain that has at least 60, 70, 80, 85, 90, 95, 98 or 99% amino acid sequence identity with a VL domain of any of those antibodies. Algorithms that can be used to calculate % identity of two amino acid sequences include e.g. BLAST, FASTA, or the Smith-Waterman algorithm, e.g. employing default parameters. Particular variants may include one or more amino acid sequence alterations (addition, deletion, substitution and/or insertion of an amino acid residue).

Alterations may be made in one or more framework regions and/or one or more CDRs. Variants are optionally provided by CDR mutagenesis. The alterations normally do not result in loss of function, so an antibody comprising a thus-altered amino acid sequence may retain an ability to bind MTP-2. It may retain the same quantitative binding ability as an antibody in which the alteration is not made, e.g. as measured in an assay described herein. The antibody comprising a thus-altered amino acid sequence may have an improved ability to bind and/or inhibit MTP-2.

Alteration may comprise replacing one or more amino acid residue with a non-naturally occurring or non-standard amino acid, modifying one or more amino acid residue into a non-naturally occurring or non-standard form, or inserting one or more non-naturally occurring or non-standard amino acid into the sequence. Examples of numbers and locations of alterations in sequences of the invention are described elsewhere herein. Naturally occurring amino acids include the 20 "standard" L-amino acids identified as G, A, V, L, I, M, P, F, W, S, T, N, Q, Y, C, K, R, H, D, E by their standard single-letter codes. Non-standard amino acids include any other residue that may be incorporated into a polypeptide backbone or result from modification of an existing amino acid residue. Non-standard amino acids may be naturally occurring or non-naturally occurring.

The term "variant" as used herein refers to a peptide or nucleic acid that differs from a parent polypeptide or nucleic acid by one or more amino acid or nucleic acid deletions, substitutions or additions, yet retains one or more specific functions or biological activities of the parent molecule. Amino acid substitutions include alterations in which an amino acid is replaced with a different naturally-occurring amino acid residue. Such substitutions may be classified as "conservative", in which case an amino acid residue contained in a polypeptide is replaced with another naturally occurring amino acid of similar character either in relation to polarity, side chain functionality or size. Such conservative substitutions are well known in the art. Substitutions encompassed by the present invention may also be "non-conservative", in which an amino acid residue which is present in a peptide is substituted with an amino acid having different properties, such as naturally-occurring amino acid from a different group (e.g., substituting a charged or hydrophobic amino; acid with alanine), or alternatively, in which a naturally-occurring amino acid is substituted with a non-conventional amino acid. In some embodiments amino acid substitutions are conservative. Also encompassed within the term variant when used with reference to a polynucleotide or polypeptide, refers to a polynucleotide or polypeptide that can vary in primary, secondary, or tertiary structure, as compared to a reference polynucleotide or polypeptide, respectively (e.g., as compared to a wild-type polynucleotide or polypeptide).

In some aspects, one can use "synthetic variants", "recombinant variants", or "chemically modified" polynucleotide variants or polypeptide variants isolated or generated using methods well known in the art. "Modified variants" can include conservative or non-conservative amino acid changes, as described below. Polynucleotide changes can result in amino acid substitutions, additions, deletions, fusions and truncations in the polypeptide encoded by the reference sequence. Some aspects use include insertion variants, deletion variants or substituted variants with substitutions of amino acids, including insertions and substitutions of amino acids and other molecules) that do not normally occur in the peptide sequence that is the basis of the variant, for example but not limited to insertion of ornithine which do not normally occur in human proteins. The term "conservative substitution," when describing a polypeptide, refers to a change in the amino acid composition of the polypeptide that does not substantially alter the polypeptide's activity. For example, a conservative substitution refers to substituting an amino acid residue for a different amino acid residue that has similar chemical properties (e.g., acidic, basic, positively or negatively charged, polar or nonpolar, etc.). Conservative amino acid substitutions include replacement of a leucine with an isoleucine or valine, an aspartate with a glutamate, or a threonine with a serine. Conservative substitution tables providing functionally similar amino acids are well known in the art. For example, the following six groups each contain amino acids that are conservative substitutions for one another: 1) Alanine (A), Serine (S), Threonine (T); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); and 6) Phenylalanine (F), Tyrosine (Y), Tryptophan (N). (See also Creighton, Proteins, W. H. Freeman and Company (1984), incorporated by reference in its entirety.) In some embodiments, individual substitutions, deletions or additions that alter, add or delete
a single amino acid or a small percentage of amino acids can
also be considered "conservative substitutions" if the change
does not reduce the activity of the peptide. Insertions or
deletions are typically in the range of about 1 to 5 amino
acids. The choice of conservative amino acids may be
selected based on the location of the amino acid to be
substituted in the peptide, for example if the amino acid is
on the exterior of the peptide and expose to solvents, or on
the interior and not exposed to solvents.

One can select the amino acid that will substitute an
existing amino acid based on the location of the existing
amino acid, including its exposure to solvents (i.e., if the
amino acid is exposed to solvents or is present on the outer
surface of the peptide or polypeptide as compared to inter-
nally localized amino acids not exposed to solvents). Selec-
tion of such conservative amino acid substitutions are well
known in the art, for example as disclosed in Dordo et al, J.
Mol Biol, 1999, 217, 721-739 and Taylor et al, J. Theor.
Biol. 119(1986); 205-218 and S. French and B. Robson, J.
Mol. Evol. 19(1983)171. Accordingly, one can select con-
servative amino acid substitutions suitable for amino acids
on the exterior of a protein or peptide (i.e. amino acids
exposed to a solvent), for example, but not limited to, the
following substitutions can be used: substitution of Y with F,
T with S or K, P with A, E with D or Q, N with D or G, R
with K, G with N or A, T with S or K, D with N or E, I with
L or V, F with Y, S with T or A, R with K, G with N or A,
K with R, A with S, K or P.

In alternative embodiments, one can also select conser-
vative amino acid substitutions encompassed suitable for
amino acids on the interior of a protein or peptide, for
example one can use suitable conservative substitutions for
amino acids is on the interior of a protein or peptide (i.e. the
amino acids are not exposed to a solvent), for example but
not limited to, one can use the following conservative
substitutions: where Y is substituted with F, T with A or S,
I with L or V, W with Y, M with L, N with D, G with A, T
with A or S, D with N, I with L or V, F with Y or L, S with
A or T and A with S, G, T or V. In some embodiments,
non-conservative amino acid substitutions are also encom-
passed within the term of variants.

The invention includes methods of producing antibodies
containing VH and/or VL domain variants of the antibody
VH and/or VL domains shown in Table S. Such antibodies
may be produced by a method comprising (i) providing, by way of addition, deletion, substitution or
insertion of one or more amino acids in the amino acid
sequence of a parent antibody VH domain, an antibody VH
domain that is an amino acid sequence variant of the parent
antibody VH domain, wherein the parent antibody VH
domain is the VH domain of any of NORI-001 to NORI-033
or a VH domain comprising the heavy chain complemen-
tarity determining regions of any of those antibodies, (ii) optionally combining the VH domain thus provided
with a VL domain, to provide a VH/VL combination, and (iii) testing the VH domain or VH/VL domain combina-
tion thus provided to identify an antibody with one or more
desired characteristics.

The VH domain may be the VH domain of NORI-003. It
may be the VH domain of NORI-006. It may be the VH
domain of NORI-011. It may be the VH domain of NORI-
008.

Desired characteristics include binding to human and/or
non-human MTP-2. Antibodies with comparable or higher
affinity for human and/or mouse MTP-2 relative to the
parent antibody may be identified. Other desired characteristics include inhibition in enzymatic assays described
herein, and in vivo reduction of serum iron concentration
and/or TSAT, and increase in hamp mRNA. Identifying an
antibody with a desired characteristic may comprise identi-
fying an antibody with a functional attribute described
herein, such as its affinity, cross-reactivity, specificity, or
neutralising potency, any of which may be determined in
assays as described herein.

When VL domains are included in the method, the VL
domain may be a VL domain of any of NORI-001 to
NORI-033, or may be a variant provided by way of addition,
deletion, substitution or insertion of one or more amino acids
in the amino acid sequence of a parent VL domain, wherein
the parent VL domain is the VL domain of any of NORI-001
to NORI-033 or a VL domain comprising the light chain
complementarity determining regions of any of those anti-
bodies. The VL domain may be the VL domain of the same
antibody as the VH domain. It may be the VL domain of
NORI-003. It may be the VL domain of NORI-006. It may
be the VL domain of NORI-011. It may be the VL domain
of NORI-008.

Methods of generating variant antibodies may optionally
comprise producing copies of the antibody or VH/VL
domain combination. Methods may further comprise
expressing the resultant antibody. It is possible to produce
nucleotide sequences corresponding to a desired antibody
VH and/or VL domain, optionally in one or more expression
vectors. Suitable methods of expression, including recom-
binant expression in host cells, are set out in detail herein.
Encoding Nucleic Acids and Methods of Production Isolated nucleic acid may be provided, encoding antibod-
ies according to the present invention. Nucleic acid may be
DNA and/or RNA. Genomic DNA, cDNA, mRNA or other
RNA, of synthetic origin, or any combination thereof can
encode an antibody.

The present invention provides constructs in the form of
plasmids, vectors, transcription or expression cassettes
which comprise at least one polynucleotide as above. Exem-
plary nucleotide sequences are included in the sequence
listing. Reference to a nucleotide sequence as set out herein
encompasses a DNA molecule with the specified sequence,
and encompasses a RNA molecule with the specified
sequence in which U is substituted for T, unless context
requires otherwise.

The present invention also provides a recombinant host
cell that comprises one or more nucleic acids encoding the
antibody. Methods of producing the encoded antibody may
comprise expression from the nucleic acid, e.g., by culturing
recombinant host cells containing the nucleic acid. The
antibody may thus be obtained, and may be isolated and/or
purified using any suitable technique, then used as appro-
priate. A method of production may comprise formulating
the product into a composition including at least one addi-
tional component, such as a pharmaceutically acceptable
excipient.

Systems for cloning and expression of a polypeptide in a
variety of different host cells are well known. Suitable host
cells include bacteria, mammalian cells, plant cells, filamen-
tous fungi, yeast and baculovirus systems and transgenic
plants and animals.

The expression of antibodies and antibody fragments in
prokaryotic cells is well established in the art. A common
bacterial host is E. coli. Expression in eukaryotic cells in
culture is also available to those skilled in the art as an option
for production. Mammalian cell lines available in the art for
expression of a heterologous polypeptide include Chinese
hamster ovary (CHO) cells, HeLa cells, baby hamster kidney cells, NSO mouse melanoma cells, YB2/0 rat myeloma cells, human embryonic kidney cells (e.g., HEK293), human embryonic retina cells and many others.

Vectors may contain appropriate regulatory sequences, including promoter sequences, terminator sequences, poly-adenylation sequences, enhancer sequences, marker genes and other sequences as appropriate. Nucleic acid encoding an antibody can be introduced into a host cell. Nucleic acid of the invention may be integrated into the genome (e.g. chromosome) of the host cell. Integration may be promoted by inclusion of sequences that promote recombination with the genome, in accordance with standard techniques. Nucleic acid can be introduced to eukaryotic cells by various methods, including calcium phosphate transfection, DEAE-Dextran, electroporation, liposome-mediated transfection and transduction using retrovirus or other virus, e.g. vaccinia or, for insect cells, baculovirus. Introducing nucleic acid in the host cell, in particular a eukaryotic cell may use a viral or a plasmid based system. The plasmid system may be maintained episomally or may be incorporated into the host cell or into an artificial chromosome. Incorporation may be either by random or targeted integration of one or more copies at single or multiple loci. For bacterial cells, suitable techniques include calcium chloride transformation, electroporation and transfection using bacteriophage. The introduction may be followed by expressing the nucleic acid, e.g., by culturing host cells under conditions for expression of the gene, then optionally isolating or purifying the binder polypeptide, e.g., antibody.

Formulation and Administration

Binder polypeptides according to the present invention, and their encoding nucleic acid molecules, will usually be provided in isolated form. VH and/or VL domains, and nucleic acids may be provided purified from their natural environment or their production environment. Isolated binder polypeptides and isolated nucleic acid will be free or substantially free of material with which they are naturally associated, such as other polypeptides or nucleic acids with which they are found in vivo, or the environment in which they are prepared (e.g., cell culture) when such preparation is by recombinant DNA technology in vitro. Optionally an isolated binder polypeptide or nucleic acid (1) is free of at least some other proteins with which it would normally be found, (2) is essentially free of other proteins from the same source, e.g., from the same species, (3) is expressed by a cell from a different species, (4) has been separated from at least about 50 percent of polynucleotides, lipids, carbohydrates, or other materials with which it is associated in nature, (5) is operably associated (by covalent or noncovalent interaction) with a polypeptide with which it is not associated in nature, or (6) does not occur in nature.

Binder polypeptides or their encoding nucleic acids may be formulated with diluents or adjuvants and still for practical purposes be isolated—for example they may be mixed with carriers if used to coat microtitre plates for use in immunoassays, and may be mixed with pharmaceutically acceptable carriers or diluents when used in therapy. As described elsewhere herein, other active ingredients may also be included in therapeutic preparations. The binder polypeptide may be glycosylated, either naturally in vivo or by systems of heterologous eukaryotic cells such as CHO cells, or it may be (for example if produced by expression in a prokaryotic cell) unglycosylated. The invention encompasses antibodies having a modified glycosylation pattern.

Typically, an isolated product constitutes at least about 5%, at least about 10%, at least about 25%, or at least about 50% of a given sample. A binder polypeptide may be substantially free from proteins or polypeptides or other contaminants that are found in its natural or production environment that would interfere with its therapeutic, diagnostic, prophylactic, research or other use.

The invention provides therapeutic compositions comprising the binder polypeptides described herein. Therapeutic compositions comprising nucleic acid encoding such binder polypeptides are also provided. Encoding nucleic acids are described in more detail elsewhere herein and include DNA and RNA, e.g., mRNA. In therapeutic methods described herein, use of nucleic acid encoding the binder polypeptide, and/or of cells containing such nucleic acid, may be used as alternatives (or in addition) to compositions comprising the binder polypeptide itself. Cells containing nucleic acid encoding the binder polypeptide, optionally wherein the nucleic acid is stably integrated into the genome, thus represent medicaments for therapeutic use in a patient. Nucleic acid encoding the binder polypeptide may be introduced into human cells derived from the intended patient and modified ex vivo. Administration of cells containing the encoding nucleic acid to the patient provides a reservoir of cells capable of expressing the binder polypeptide, which may provide therapeutic benefit over a longer term compared with administration of isolated nucleic acid or the isolated binder polypeptide. Nucleic acid may also be administered directly to the patient for gene therapy. Thus, nucleic acid encoding the binder polypeptide may be provided for use in gene therapy, comprising introducing the encoding nucleic acid into cells of the patient in vivo, so that the nucleic acid is expressed in the patient's cells and provides a therapeutic effect, examples of which are disclosed herein, including increase in hamp mRNA, reduction of serum iron, reduction of TSAT, and treatment of diseases and conditions associated with iron overload.

Compositions may contain suitable carriers, excipients, and other agents that are incorporated into formulations to provide improved transfer, delivery, tolerance, and the like. A multitude of appropriate formulations can be found in the formulary known to all pharmaceutical chemists: Remington's Pharmaceutical Sciences, Mack Publishing Company, Easton, Pa. These formulations include, for example, powders, pastes, ointments, jellies, waxes, oils, lipids, lipid (cationic or anionic) containing vesicles (such as LIPO-FECTINT™), DNA conjugates, anhydrous absorption pastes, oil-in-water and water-in-oil emulsions, emulsions carbowax (polyethylene glycols of various molecular weights), semi-solid gels, and semi-solid mixtures containing carbowax. See also Powell et al. "Compendium of excipients for parenteral formulations" PDA (1998) J Pharm Sci Technol 52:238-311. Compositions may comprise the antibody or nucleic acid in combination with medical injection buffer and/or with adjuvant.

Binder polypeptides, or their encoding nucleic acids, may be formulated for the desired route of administration to a patient, e.g., in liquid (optionally aqueous solution) for injection.

Various delivery systems are known and can be used to administer the pharmaceutical composition of the invention. Methods of introduction include, but are not limited to, intradermal, intramuscular, intraperitoneal, intravenous, subcutaneous, intranasal, epidural, and oral routes. The composition may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local. The antigen-binding molecules are preferably administered by subcutaneous injection. Administration may be self-administration by a patient, e.g., self-injection.

The pharmaceutical composition can be also delivered in a vesicle, in particular a liposome (see Langer (1990) Science 249:1527-1533; Treat et al. (1989) in Liposomes in the Therapy of Infectious Disease and Cancer, Lopez Berestein and Fidler (eds.), Liss, New York, pp. 353-365; Lopez-Berestein, ibid., pp. 317-327; see generally ibid.).

In certain situations, the pharmaceutical composition can be delivered in a controlled release system. In one embodiment, a pump may be used (see Langer, supra; Sefton (1987) CRC Crit. Ref. Biomed. Eng. 14:201). In another embodiment, polymeric materials can be used; see, Medical Applications of Controlled Release, Langer and Wise (eds.), CRC Pres., Boca Raton, Fla. (1974). In yet another embodiment, a controlled release system can be placed in proximity of the composition's target, thus requiring only a fraction of the systemic dose (see, e.g., Goodson, in Medical Applications of Controlled Release, supra, vol. 2, pp. 115-138, 1984).

The injectable preparations may include dosage forms for intravenous, subcutaneous, intracutaneous and intramuscular injections, drip infusions, etc. These injectable preparations may be prepared by methods publicly known. For example, the injectable preparations may be prepared, e.g., by dissolving, suspending or emulsifying the antibody or its salt described above in a sterile aqueous medium or an oily medium conventionally used for injections. As the aqueous medium for injections, there are, for example, physiological saline, an isotonic solution containing glucose and other auxiliary agents, etc., which may be used in combination with an appropriate solubilizing agent such as an alcohol (e.g., ethanol), a polyalcohol (e.g., propylene glycol, polyethylene glycol), a nonionic surfactant [e.g., polysorbate 80, HCO-50 (polyoxyethylene (50 mol) adduct of hydrogenated castor oil)], etc. As the oily medium, there are employed, e.g., sesame oil, soybean oil, etc., which may be used in combination with a solubilizing agent such as benzyl benzoate, benzyl alcohol, etc. The injection thus prepared can be filled in an appropriate ampoule. A pharmaceutical composition of the present invention can be delivered subcutaneously or intravenously with a standard needle and syringe. It is envisaged that treatment will not be restricted to use in the clinic. Therefore, subcutaneous injection using a needle-free device is also advantageous. With respect to subcutaneous delivery, a pen delivery device readily has applications in delivering a pharmaceutical composition of the present invention. Such a pen delivery device can be reusable or disposable. A reusable pen delivery device generally utilizes a replaceable cartridge that contains a pharmaceutical composition. Once all of the pharmaceutical composition within the cartridge has been administered and the cartridge is empty, the empty cartridge can readily be discarded and replaced with a new cartridge that contains the pharmaceutical composition. The pen delivery device can then be reused. In a disposable pen delivery device, there is no replaceable cartridge. Rather, the disposable pen delivery device comes prefilled with the pharmaceutical composition held in a reservoir within the device. Once the reservoir is emptied of the pharmaceutical composition, the entire device is discarded. Numerous reusable pen and autoinjector delivery devices have applications in the subcutaneous delivery of a pharmaceutical composition of the present invention. Examples include, but certainly are not limited to AUTOPEN™ (Owen Mumford, Inc., Woodstock, UK), DISETRONIC™ pen (Disetronic Medical Systems, Burghdorf, Switzerland), HUMALOG MIX 75/25™ pen, HUMALOG™ pen, HUMALIN 70/30™ pen (Eli Lilly and Co., Indianapolis, Ind.), NOVOPENT™, II and III (Novo Nordisk, Copenhagen, Denmark), NOVOPEN JUNIOR™ (Novo Nordisk, Copenhagen, Denmark), BD™ pen (Becton Dickinson, Franklin Lakes, N.J.), OPTIPENT™, OPTIPEN PRO™, OPTIPEN STARLET™, and OPTICLIKT™ (Sanofi-Aventis, Frankfurt, Germany), to name only a few. Examples of disposable pen delivery devices having applications in subcutaneous delivery of a pharmaceutical composition of the present invention include, but certainly are not limited to the SOLOSTAR™ pen (Sanofi-Aventis), the FLEXPEN™ (Novo Nordisk), and the KWIKPEN™ (Eli Lilly).

Advantageously, the pharmaceutical compositions for oral or parenteral use described above are prepared into dosage forms in a unit dose suited to fit a dose of the active ingredients. Such dosage forms in a unit dose include, for example, tablets, pills, capsules, injections (ampoules), suppositories, etc. The amount of the aforesaid antibody contained is generally about 5 to about 500 mg per dosage form in a unit dose; especially in the form of injection, the aforesaid antibody may be contained in about 5 to about 100 mg and in about 10 to about 250 mg for the other dosage forms.

The binder polypeptide, nucleic acid, or composition comprising it, may be contained in a medical container such as a phial, syringe, IV container or an injection device. In an example, the binder polypeptide, nucleic acid or composition is in vitro, and may be in a sterile container. In an example, a kit is provided comprising the binder polypeptide, packaging and instructions for use in a therapeutic method as described herein.

One aspect of the invention is a composition comprising a binder polypeptide or nucleic acid of the invention and one or more pharmaceutically acceptable excipients, examples of which are listed above. "Pharmaceutically acceptable" refers to approved or approvable by a regulatory agency of the USA Federal or a state government or listed in the U.S. Pharmacopeia or other generally recognized pharmacopeia for use in animals, including humans. A pharmaceutically acceptable carrier, excipient, or adjuvant can be administered to a patient, together with a binder polypeptide, e.g., any antibody or polypeptide molecule described herein, and does not destroy the pharmacological activity thereof and is nontoxic when administered in doses sufficient to deliver a therapeutic amount of the agent.

In some embodiments, the binder polypeptide will be the sole active ingredient in a composition according to the present invention. Thus, a composition may consist of the antibody or it may consist of the binder polypeptide with one or more pharmaceutically acceptable excipients. However, compositions according to the present invention optionally include one or more additional active ingredients. Other therapeutic agents that it may be desirable to administer with binder polypeptides or nucleic acids according to the present invention include other therapeutic agents for iron overload, examples of which are described herein. Any such agent or combination of agents may be administered in combination with, or provided in compositions with binder polypeptides or nucleic acids according to the present invention, whether as a combined or separate preparation. The binder polypeptide or nucleic acid according to the present invention may be administered separately and sequentially, or concurrently and optionally as a combined preparation, with another therapeutic agent or agents such as those mentioned.

Multiple compositions can be administered separately or simultaneously. Separate administration refers to the two compositions being administered at different times, e.g. at least 10, 20, 30, or 10-60 minutes apart, or 1, 2, 3, 4, 5, 6, 7, 8, 9, 10, 12 hours apart. One can also administer compositions at 24 hours apart, or even longer apart. Alternatively, two or more compositions can be administered simultaneously, e.g. less than 10 or less than 5 minutes apart. Compositions administered simultaneously can, in some aspects, be administered as a mixture, with or without similar or different time release mechanism for each of the components.

Binder polypeptides, and their encoding nucleic acids, can be used as therapeutic agents. Patients herein are generally mammals, typically humans. A binder polypeptide or nucleic acid may be administered to a mammal, e.g., by any route of administration mentioned herein. In a preferred embodiment, a binder polypeptide is administered by subcutaneous injection.

Administration is normally in a "therapeutically effective amount", this being an amount that produces the desired effect for which it is administered, sufficient to show benefit to a patient. The exact amount will depend on the purpose of the treatment, and will be ascertainable by one skilled in the art using known techniques (see, for example, Lloyd (1999) The Art, Science and Technology of Pharmaceutical Compounding). Prescription of treatment, e.g. decisions on dosage etc, is within the responsibility of general practitioners and other medical doctors and may depend on the severity of the symptoms and/or progression of a disease being treated. A therapeutically effective amount or suitable dose of binder polypeptide or nucleic acid can be determined by comparing its in vitro activity and in vivo activity in an animal model. Methods for extrapolation of effective dosages in mice and other test animals to humans are known.

In methods of treatment described herein, one or more doses may be administered. In some cases, a single dose may be effective to achieve a long-term benefit. Thus, the method may comprise administering a single dose of the binder polypeptide, its encoding nucleic acid, or the composition. Alternatively, multiple doses may be administered, usually sequentially and separated by a period of days, weeks or months. For example, administration may be every 2 weeks, every 3 weeks or every 4 weeks. Optionally, the binder polypeptide may be administered to a patient once a month, or less frequently, e.g., every two months or every three months.

As used herein, the terms "treat," "treatment," "treating," or "amelioration" refer to therapeutic treatments, wherein the object is to reverse, alleviate, ameliorate, inhibit, slow down or stop the progression or severity of a condition associated with a disease or disorder. The term "treating" includes reducing or alleviating at least one adverse effect or symptom of a condition, disease or disorder. Treatment is generally "effective" if one or more symptoms or clinical markers are reduced. Alternatively, treatment is "effective" if the progression of a disease is reduced or halted. That is, "treatment" includes not just the improvement of symptoms or markers, but also a cessation of, or at least slowing of, progress or worsening of symptoms compared to what would be expected in the absence of treatment. Beneficial or desired clinical results include, but are not limited to, alleviation of one or more symptom(s), diminishment of extent of disease, stabilised (i.e., not worsening) state of disease, delay or slowing of disease progression, amelioration or palliation of the disease state, remission (whether partial or total), and/or decreased mortality, whether detectable or undetectable. The term "treatment" of a disease also includes providing relief from the symptoms or side-effects of the disease (including palliative treatment). For treatment to be effective a complete cure is not contemplated. The method can in certain aspects include cure as well. In the context of the invention, treatment may be preventative treatment.

Long half-life is a desirable feature in the binder polypeptides of the present invention. Extended half-life translates to less frequent administration, with fewer injections being required to maintain a therapeutically effective concentration of the molecule in the bloodstream. The in vivo half life of antigen-binding molecules of the present invention in humans may be 7, 8, 9, 10, 11, 12, 13, 14, 15, 16, 17, 18, 19, 20 or 21 days, or longer. The in vivo half life of antigen-binding molecules in non-human primates such as cynomolgus monkeys may be 7, 8, 9, 10, 11, 12, 13, 14, 15, 16, 17, 18, 19, 20 or 21 days, or longer.

Binder polypeptides may be provided for administration at regular intervals of one week, two weeks, three weeks, four weeks, or one month.

Therapeutic Use

Therapeutic indications addressed by the present invention include treating patients in whom it is beneficial to inhibit MTP-2 activity and/or to reduce iron uptake. A particular therapeutic area is anaemia characterised by high iron loading and deposition and inefficient erythropoiesis. As previously discussed, several forms of anaemia are characterised by an ineffective erythropoiesis often accompanied by a primary iron overload (driven by inappropriately low hepcidin levels due to high erythropoietic activity) and secondary iron overload mainly due to repeated red blood cell transfusions. Iron overload has a negative impact on organ function and negatively influences erythropoiesis, contributing to the anaemia by increasing hemichrome and ROS in the erythroblast progenitors and driving apoptosis so that there are fewer functional erythrocytes. Decreasing iron reduces apoptosis and improves the alpha/beta globin imbalance, allowing production of more mature erythrocytes. Decreased iron availability to erythroid cells leads to reduced production of haem, increased maturation of erythroid precursors, and increase in haemoglobin levels. Thus, in some conditions, the therapeutic mode of action of a binder polypeptide may be inhibition of enzymatic activity of MTP-2 causing increased levels of hepcidin which results in iron restriction that normalises erythropoiesis and improves haemoglobin and erythrocyte quality.

As well as addressing the toxic effects of iron overload, treatment of the anaemia may in turn improve cardiac function and reduce fatigue.

Effects of treatment according to the present invention may include:

reducing absorption of dietary iron,
treating iron overload,
elevating expression of hepcidin from hepatocytes,
reducing anaemia caused by iron overload,
decreasing serum iron concentration,
decreasing transferrin iron saturation,
reducing need for blood transfusions,
reducing need for iron chelation therapy,
extending survival, and/or
normalising erythropoiesis.

Treatment may be of benefit in a number of conditions which are discussed herein, including:

lower risk myelodysplastic syndrome (MDS) with ring sideroblasts (RARS) requiring blood transfusions
5 q-MDS;
transfusion dependent beta-thalassaemia or beta-thalassaemia major;

transfusion independent beta-thalassaemia or beta-thalassaemia intermedia;

haemochromatosis, e.g., in patients not carrying mutations in HJV or hepcidin, or in haemochromatosis Type 1 or Type 3;

liver cirrhosis;

liver steatosis;

liver fibrosis, e.g., in NASH (non-alcoholic steatohepatitis) or ASH patients;

Blackfan Diamond anaemia;

pulmonary arterial hypertension;

anaemia in sickle cell disease ("sickle cell anaemia");

polycythemia vera;

chronic kidney disease-associated anemia (CKD).

Accordingly, a patient treated according to the present invention may have one of the above conditions. Methods of treatment may comprise administering a binder polypeptide, nucleic acid or composition as described herein to the patient. Examples of formulations and methods of administration are described elsewhere herein. According to the disease condition, treatment may begun starting soon after birth, following diagnosis or with the start of transfusion dependence or increased serum ferritin or when iron chelation would be otherwise started.

It is believed that the increase in hepcidin levels, with treatment using an anti-MTP-2 binder polypeptide, will lead to reduced TSAT levels accompanied by reduced induction of haem and hemichrome production in beta-thalassaemia or reduced ringsideroblast occurrence in MDS. This will result in less apoptosis of erythroid progenitors and higher red blood cell count. Although single cell haemoglobin content will be lower, due to the increase in red blood cell number total haemoglobin levels will be higher. This will then reduce the requirement for red blood cell transfusion.

Avoidance of toxic tissue iron overloading, or reduction of the risk thereof, should increase overall survival in patients, i.e., extend survival in a treated patient. By avoiding or reducing the burden of blood transfusions, and/or avoiding or reducing the need for iron chelation and/or phlebotomy, quality of patients' life should also be improved.

Treatments may reduce the disease burden and symptoms of conditions such as beta thalassaemia, MDS and haemochromatosis which are linked to iron metabolism, including toxic iron overload, heart failure, liver failure, diabetes and reduced overall survival.

Interestingly, a genetic polymorphism 736 V(A)->A(G) in Tmprss6 is associated with higher hepcidin levels and has been reported to reduce iron overload in some of these diseases and to ameliorate liver enzymes, suggesting a positive influence of increased hepcidin levels on liver regeneration. Mouse studies have shown a beneficial effect of Tmprss6 and/or hepcidin increase in mouse liver fibrosis models.

Inhibition of MTP-2 may also be of use for treatment of obesity. Folgueras et al reported that MTP-2 deficiency protects from obesity by modulating iron homeostasis (Folgueras et al., Nat Commun. April 10; 9(1):1350 2018).

Desirably, effective treatment of patients is obtained without serious adverse effects. No side effects, or only minor side effects, may be observed.

Treatment with a binder polypeptide according to the present invention may be combined with one or more additional therapies, for example, a further therapeutic agent for treating iron overload. The binder polypeptide may be combined with an activin type II receptor agonist fusion protein, e.g., luspatercept. Since an MTP-2 inhibitor presents an alternative mode of action to other planned and existing therapies, it potentially offers synergistic effects on erythropoiesis. A combination of (i) an inhibitor of MTP-2 and (ii) an antagonist of a TGFβ superfamily ligand, e.g., a TGFβ superfamily receptor-based ligand scavenger/trap, may therefore produce advantageous therapeutic effects.

Various ligand traps act on the TGFβ superfamily to increase late-stage erythropoiesis. TGFβ superfamily ligands include activin, GDF-11 and bone morphogenic proteins (BMPs). Receptor ligand trap molecules can be produced by providing the extracellular domain of the receptor in soluble form, in which it retains an ability to bind its ligand(s) but without inducing downstream signalling (which would otherwise result from the normal receptor: ligand interaction). The receptor extracellular domain may be linked to an Fc region to form a fusion protein.

Preferably the receptor is an activin II receptor, e.g., ActIIRA or ActIIRB. The antagonist may be a polypeptide comprising the soluble extracellular domain of an activin II receptor, e.g., activin receptor IIB (ActRIIB), fused to an Fc region. Luspatercept is one such molecule, which is currently used to treat anaemia in beta-thalassaemia and myelodysplastic syndromes. Examples of ActRIIA and ActRIIB ligand traps can also be found in Acceleron Pharma's U.S. Pat. No. 7,988,973, incorporated by reference herein. Suragani R N, et al previously described "RAP-536", a modified human ActRIIB extracellular domain (residues 24-131 of the native precursor with a L79D substitution) linked to a murine IgG2a Fc domain, which was reported to mitigate ineffective erythropoiesis and disease complications in murine β-thalassaemia (Blood 123(25):3864-3872 2014). Sotatercept is an example of an activin type IIA receptor IgG-Fc fusion protein. Antagonists of other TGFβ family ligands can be similarly generated, e.g., a BMPR-Fc fusion protein.

Alternative antagonists include antibodies to the TGFβ superfamily ligands (e.g., anti-activin antibodies). Anti-activin A antibodies have been described, e.g., garetosmab.

An antagonist of TGFβ family ligands such as ActRIIB-Fc, ActIIRIIA-Fc or BMPR-Fc promotes the maturation of erythrocyte precursors during erythropoiesis, whilst an MTP-2 inhibitor results in a lowering of iron (towards a normalisation of pathologically high iron levels) and thus slows erythropoiesis. From studies reported herein (see Example 22), we believe that a combination of these two effects produces a more efficient generation of more matured red blood cells. We demonstrate, for example, that the combination of an MTP-2 inhibitor (represented by NORI-11-M) and an activin receptor II ligand trap (represented by ActRIIB-Fc) is more effective than the ligand trap alone, correcting both the iron overload and the associated anaemia. Combination with an MTP-2 inhibitor may extend the therapeutic potential of the TGFβ superfamily ligand trap by providing a greater therapeutic effect in patients with conditions for whom the TGFβ superfamily ligand trap is already indicated (e.g., non transfusion dependent β-thalassaemia patients). Combination with an MTP-2 inhibitor may also extend the therapeutic potential of the ligand trap to treat additional groups of patients, such as those with beta-thalassaemia major, for whom treatments such as luspatercept are currently of limited benefit.

Luspatercept was recently approved by the FDA for myelodysplastic syndrome. Iron overload starts to develop in MDS patients before they become transfusion-dependent, because ineffective erythropoiesis suppresses hepcidin production in the liver and thus leads to unrestrained intestinal iron uptake. Blood transfusions then aggravate the iron overload. The same situation occurs in transfusion dependent β-thalassaemia patients. In such patients who are being treated with luspatercept (or other TGFβ superfamily ligand trap), therapeutic benefits will be improved by including an MTP-2 inhibitor in the therapeutic regime. The combination therapy may be used for any therapeutic indication or condition described herein, e.g., Blackfan Diamond anaemia.

An inhibitor of MTP-2 which is used in combination therapy may be a binder polypeptide as described herein, or it may be another type of molecule such as a nucleic acid inhibitor of TMPRSS6 expression (e.g., an antisense or siRNA molecule targeted to TMPRSS6) or a small molecule inhibitor (e.g., 3-amidinophenylalanine-derived matriptase-1 and -2 protease inhibitors and derivatives). Examples of such inhibitors are have been described (Hammami M, Rühmann E, Maurer E, Heine A, Gütschow M, Klebe G, Steinmetzer T (2012) New 3-amidinophenylalanine-derived inhibitors of matriptase. Med Chem Commun 3:807-813; Pomothy J, Szombath G, Rokonál P, Mátis G, Zs N, Steinmetzer T, Pászti-Gere E (2016) The impact of acute matriptase inhibition in hepatic inflammatory models. Biomed Res Int. https://doi.org/10.1155/2016/6306984). Accordingly, a patient who is treated according to the present invention may be a patient who also receives treatment with a further therapeutic agent for reducing iron overload. Methods may comprise co-administering the binder polypeptide and further therapeutic agent to the patient, optionally in separate formulations. The compositions may be administered sequentially or simultaneously. The same applies where a small molecule or nucleic acid MTP-2 inhibitor is used instead of a binder polypeptide, i.e., the patient may be treated with a combination of the MTP-2 inhibitor and the further therapeutic agent, either simultaneously or sequentially. The MTP-2 inhibitor and the further therapeutic agent are preferably provided in separate formulations and administered separately. In general, sequential administrations may be performed on the same day (optionally separated by a period of minutes or hours) or on different days.

Treatment with an MTP-2 inhibitor (e.g. a binder polypeptide as described herein) may be combined with erythropoietin (epo). Darbepoetin alfa, commercially known as ARANESP, is a structurally re-engineered form of epo to prolong half-life of the drug compared with standard epo alpha and epo beta proteins. It is used to stimulate erythropoiesis in anaemia patients to increase haemoglobin levels and reduce transfusion need. The drug is administered at different doses depending on the severity of the anaemia, however, in chronic kidney disease-associated anemia (CKD) patients the recommended starting dose is 0.45 mcg/kg iv/sc every four weeks until haemoglobin levels reach above 10 g/dL, when the dose can then be reduced. ARANESP has been shown to improve haemoglobin levels in a small study on beta thalassaemia intermedia patients (Singer et al. 2011), however, in general it is not a therapeutic option for beta-thalassaemia patients due to an unacceptable increase in RBC apoptosis and associated splenomegaly. As the results presented herein show, therapeutic benefits may be obtained by treating a patient with a binder polypeptide according to the present invention and with epo. For example, it should be possible to co-administer ARANESP and anti-MTP-2 mAb therapies in humans via two separate sc injections performed at the same time every 2-4 weeks. Based on the results obtained in the beta-thalassaemia mouse model (see Examples 20 and 21), such co-treatment strategy should provide the therapeutic improvement in anemia from the ARANESP therapy whilst maintaining spleen size and simultaneously reducing toxic iron overload provided by the anti-MTP2 treatment. The exact combined dosing regimen can be investigated and optimised for humans, but will in general involve administering a binder polypeptide according to the present invention to a patient and also administering erythropoietin (preferably recombinant erythropoietin or a medically approved variant thereof, e.g., darbepoetin alfa). Optionally, the binder polypeptide and the epo are administered simultaneously. Alternatively they may be administered sequentially (on the same day, or on different days). Optionally, the binder polypeptide and the epo are administered subcutaneously, in separate injections or in a combined injection. In some embodiments, the invention provides treatment of patients with epo and a binder polypeptide, wherein administration of the binder polypeptide reduces erythrocyte apoptosis and associated splenomegaly associated with administration of the epo, e.g., in a patient having a condition mentioned herein such as beta-thalassaemia. A binder polypeptide may thus be used to normalise erythropoiesis in a patient who is receiving treatment with epo.

BRIEF DESCRIPTION OF THE DRAWINGS

Embodiments of the invention will now be described in more detail, with reference to the drawings, in which:

FIG. 3 shows full dose response curves for selected anti-MTP-2 antibodies and a negative control antibody in a protein-based enzymatic assay with (a) human and (b) mouse MTP-2. All antibodies are isotype human IgG4PE.

FIG. 4 shows % inhibitory effect of antibodies in an enzymatic assay with human MTP-2 ECD plotted against % inhibitory effect of antibodies in an enzymatic assay with mouse MTP-2 ECD for (a) a first and (b) a second group of antibodies obtained from transgenic mouse immunisations.

FIG. 9 shows (a) hamp mRNA levels and (b) serum iron levels from wild-type mice treated with anti-MTP-2 antibodies or controls.

FIG. 14 shows the results of an assessment of IgG/kappa anti-MTP2 antibodies for reducing serum iron and transferrin saturation at the 1 week timepoint (10 mg/kg IP dose)

FIG. 16 shows (a) serum iron concentration and (b) antibody concentration on day 7 following a single 10 mg/kg sc or ip injection of antibody. In (a), dark circles represent huIgG4PE isotype control and grey squares represent NORI-010.

FIG. 18 shows the results of a second in vivo rat study, in which NORI-008, NORI-011, NORI-003 and NORI-006 were each dosed at 10 mg/kg SQ in groups of 5 wild type Han Wistar rats.

FIG. 20 shows the results of an 8 week study in a Hbbth3/+ mouse model of thalassaemia intermedia with NORI-011-M in the presence or absence of erythropoietin. a) hepcidin mRNA measured by qPCR from liver samples, b) red blood cell count, c) liver iron tissue content per g of tissue wet weight, d) haemoglobin levels, e) haematocrit, f) mean corpuscular volume (MCV), g) red cell distribution width (RDW), h) mean corpuscular haemoglobin (MCH), i) number of cells in development stages I-V of erythrocyte lineage cells in the spleen determined by flow cytometry, j) number of cells in development stages I-V of erythrocyte lineage cells in the bone marrow determined by flow cytometry and k) spleen index.

FIG. 21 shows the results of an 8-week study in a Hbbth3/+ mouse model of thalassaemia intermedia with NORI-011-M with or without co-treatment with ActRIIB- Fc. NORI-11-M was administered once/week ip at 10 mg/kg, ActRIIB-Fc was given twice/week ip at 10 mg/kg. All samples for read outs taken at end of 8-week study. a) hepcidin mRNA measured by qPCR from liver samples, b) liver iron tissue content per g of tissue wet weight, c) red blood cell count (RBC), d) haemoglobin levels (Hb), e) haematocrit (HCT), f) mean corpuscular volume (MCV), g) red cell distribution width (RDW), h) mean corpuscular haemoglobin (MCH), i) number of cells in development stages I-V of erythrocyte lineage cells in the spleen determined by flow cytometry, j) number of cells in development stages I-V of erythrocyte lineage cells in the bone marrow determined by flow cytometry and k) spleen index.

EXAMPLES

Figure 1:
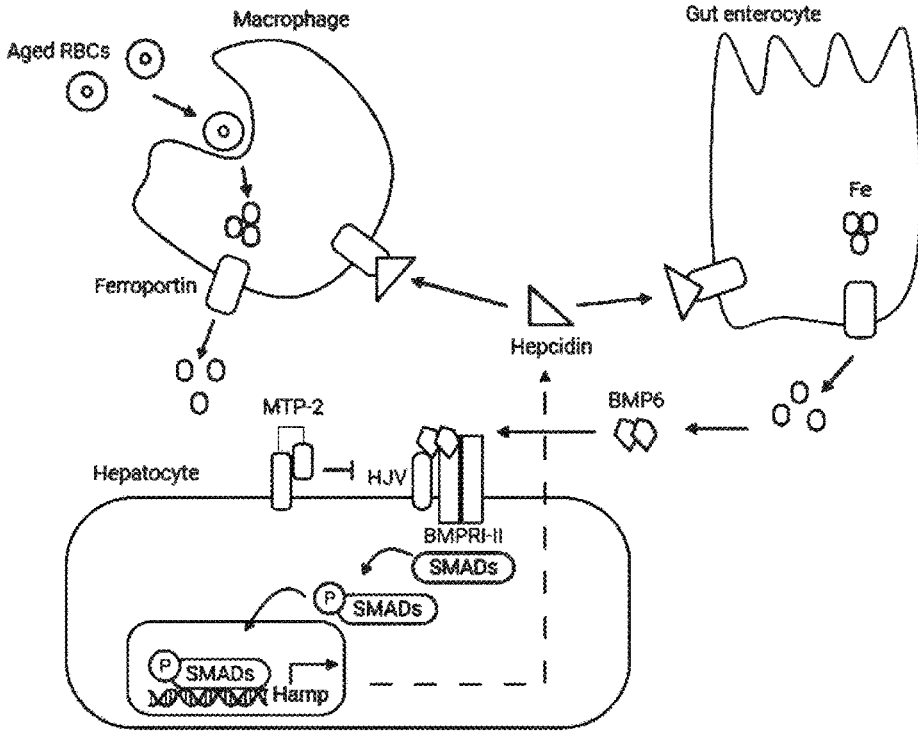
FIG. 1 is a diagram of the pathway regulating the supply of iron for erythropoesis and other cellular functions. Absorption of dietary iron, and release of iron recovered from senescent erythrocytes ("aged RBCs"), is regulated by hepcidin which downregulates ferroportin (FPN), an iron export protein found in the membrane of gut enterocytes (which ingest dietary iron) and macrophages (which ingest senescent erythrocytes). Inhibition of ferroportin reduces export of iron from these cells, thereby limiting the supply of new and recycled iron available to the body. Expression of hepcidin from the hamp gene in hepatocytes is regulated by the BMP/SMAD pathway, initiated by binding of the ligand BMP6 to receptors on the hepatocyte surface (e.g., HJV and BMPR I-II). Negative feedback from elevated serum iron concentrations may upregulate the BMP/SMAD pathway to increase hepcidin expression and thereby reduce the release of iron via ferroportin. Matriptase-2 (MTP-2) is also present on the hepatocyte surface, and downregulates the BMP/SMAD pathway, presumably by cleaving co-receptors such as HJV, thereby reducing expression of hepcidin and enabling greater release of iron via ferroportin.

Here we describe antibodies targeting MTP-2, for the treatment of diseases of iron overload. Through immunising transgenic mice which generate antibodies having human variable domains, and testing a wide diversity of antibodies in a series of biologically-relevant assays, we were able to obtain species cross-reactive, MTP-2-specific monoclonal antibodies (mAbs) which are cross-reactive neutralisers of MTP-2 enzymatic activity both in vitro and in vivo. We show that selected mAbs elevate levels of hepcidin expression from hepatocyte cells following a single dose. The elevation of hepcidin decreases serum iron and transferrin saturation through increased internalisation and degradation of ferroportin. In Hbb$^{th3/+}$ mice, representing a model of beta-thalassaemia, a single dose of 10 mg/kg produced a decrease of 52% and 47% in serum iron and transferrin saturation respectively, at the 2-week timepoint. Furthermore, with repeat dosing, we observed consistent iron restriction in a Hbb$^{th3/+}$ mice over multiple weeks. These results indicate that such mAbs have the potential to treat iron overloaded patients to reduce their anaemia and reduce their transfusion and iron chelation need.

Example 1—Generation of a Panel of Anti-MTP-2
Inhibitory Antibodies

Kymab transgenic mice, which produce antibodies with human variable domains, were immunised with MTP-2 using a variety of different immunisation regimens and antigen formats, and antigen-specific B cells were selected. See Lee et al., Nat Biotechnol 32(4):356-63 2014; WO2011/004192; WO2011/158009 and WO2013/061098. Antibodies were tested for binding to human MTP-2 and mouse MTP-2 and for their ability to inhibit enzymatic activity of human and mouse MTP-2 in protein-based and cell-based in vitro assays.

A homogeneous time resolved FRET (HTRF) assay and a flow cytometry assay were used for primary screening to establish binding of the recovered antibodies to purified MTP-2 extracellular domain (ECD), followed by confirmation of binding to cell-surface expressed MTP-2.

Cross-reactive antibodies were selected for their ability to bind both human and non-human (mouse and cynomolgus) MTP-2 ECD.

Selected antibodies were then screened in a number of functional assays to assess their ability to inhibit enzymatic activity of human and mouse purified MTP-2 ECD in solution and to inhibit enzymatic activity of human MTP-2 expressed on HEK293 cells, as assessed in enzymatic assays containing chromogenic MTP-2 substrate.

While many and diverse antibodies were obtained, including examples of antibodies that bound and inhibited human MTP-2 but not mouse MTP-2 and others that bound and inhibited mouse MTP-2 but not human MTP-2, the antibodies listed in Table G below were selected as being of particular interest for potential development as cross-reactive inhibitors of MTP-2 activity.

TABLE G

Selected anti-MTP-2 inhibitory antibodies, showing the human germline V,
D and J gene segments that generated the VH domains of these antibodies
through recombination and the human germline V and J gene segments that
generated the VL domains of these antibodies through recombination.

| | IGH V gene | IGH D gene | IGH J gene | IGL V gene | IGL J gene |
|---|---|---|---|---|---|
| NORI-001 | IGHV1-24*d01 | IGHD3-10*01 | IGHJ4*02 | IGKV1-17*01 | IGKJ1*01 |
| NORI-002 | IGHV3-49*05 | IGHD3-9*01 | IGHJ4*02 | IGKV1D-33*01 | IGKJ4*01 |
| NORI-003 | IGHV3-49*05 | IGHD3-9*01 | IGHJ4*02 | IGKV1D-33*01 | IGKJ4*01 |
| NORI-004 | IGHV3-49*05 | IGHD3-9*01 | IGHJ4*02 | IGKV1D-33*01 | IGKJ4*01 |
| NORI-005 | IGHV3-49*05 | IGHD3-9*01 | IGHJ4*02 | IGKV1D-33*01 | IGKJ4*01 |
| NORI-006 | IGHV3-49*05 | IGHD3-9*01 | IGHJ4*02 | IGKV1D-33*01 | IGKJ4*01 |
| NORI-007 | IGHV3-49*05 | IGHD3-9*01 | IGHJ4*02 | IGKV1D-33*01 | IGKJ4*01 |
| NORI-008 | IGHV4-61*01 | IGHD3-22*01 | IGHJ5*02 | IGKV1D-33*01 | IGKJ5*01 |
| NORI-009 | IGHV3-9*01 | IGHD4-17*01 | IGHJ6*02 | IGLV2-8*01 | IGLJ2*01 |
| NORI-010 | IGHV3-9*01 | IGHD4-17*01 | IGHJ6*02 | IGLV2-8*01 | IGLJ2*01 |
| NORI-011 | IGHV3-9*01 | IGHD4-17*01 | IGHJ6*02 | IGLV2-8*01 | IGLJ2*01 |
| NORI-012 | IGHV3-9*01 | IGHD4-17*01 | IGHJ6*02 | IGLV2-8*01 | IGLJ2*01 |
| NORI-013 | IGHV3-9*01 | IGHD2-21*02 | IGHJ6*02 | IGLV2-8*01 | IGLJ2*01 |
| NORI-014 | IGHV3-9*01 | IGHD2-21*02 | IGHJ6*02 | IGLV2-8*01 | IGLJ2*01 |
| NORI-015 | IGHV3-9*01 | IGHD2-21*02 | IGHJ6*02 | IGLV2-8*01 | IGLJ2*01 |
| NORI-016 | IGHV3-9*01 | IGHD2-21*02 | IGHJ6*02 | IGLV2-8*01 | IGLJ2*01 |
| NORI-017 | IGHV3-33*01 | IGHD3-16*02 | IGHJ4*02 | IGLV1-36*01 | IGLJ2*01 |
| NORI-018 | IGHV1-18*01 | IGHD6-6*01 | IGHJ5*02 | IGLV3-1*01 | IGLJ2*01 |
| NORI-019 | IGHV3-30*18 | IGHD6-19*01 | IGHJ4*02 | IGLV1-36*01 | IGLJ2*01 |
| NORI-020 | IGHV4-39*01 | IGHD3-16*02 | IGHJ4*02 | IGLV3-25*d03 | IGLJ2*01 |
| NORI-021 | IGHV3-11*01 | IGHD3-9*01 | IGHJ4*02 | IGLV1-51*01 | IGLJ3*02 |
| NORI-022 | IGHV3-48*02 | IGHD2-2*02 | IGHJ4*02 | IGLV1-40*01 | IGLJ1*01 |
| NORI-023 | IGHV3-11*01 | IGHD3-9*01 | IGHJ4*02 | IGLV1-51*01 | IGLJ3*02 |
| NORI-024 | IGHV1-18*01 | IGHD4-11*01 | IGHJ5*02 | IGLV3-10*01 | IGLJ2*01 |
| NORI-025 | IGHV3-33*01 | IGHD1-26*01 | IGHJ4*02 | IGLV1-36*01 | IGLJ2*01 |
| NORI-026 | IGHV3-30*18 | IGHD2-21*02 | IGHJ4*02 | IGKV1-6*01 | IGKJ1*01 |
| NORI-027 | IGHV1-18*01 | IGHD4-11*01 | IGHJ5*02 | IGLV3-10*01 | IGLJ2*01 |
| NORI-028 | IGHV3-20*d01 | IGHD5-12*01 | IGHJ6*02 | IGLV2-8*01 | IGLJ3*02 |
| NORI-029 | IGHV3-49*05 | IGHD3-9*01 | IGHJ6*02 | IGLV2-8*01 | IGLJ3*02 |
| NORI-030 | IGHV3-30*18 | IGHD5-12*01 | IGHJ4*02 | IGLV1-36*01 | IGLJ2*01 |
| NORI-031 | IGHV4-39*01 | IGHD5-24*01 | IGHJ5*02 | IGLV3-1*01 | IGLJ2*01 |
| NORI-032 | IGHV1-18*01 | IGHD3-10*01 | IGHJ3*02 | IGLV3-1*01 | IGLJ2*01 |
| NORI-033 | IGHV4-39*01 | IGHD3-16*02 | IGHJ4*02 | IGLV3-25*d03 | IGLJ2*01 |
| NORI-034 | IGHV1-18*01 | IGHD4-23*01 | IGHJ4*02 | IGLV3-1*01 | IGLJ2*01 |

Example 2—Antibody Sequences

Sequences of the HCDRs, LCDRS, VH domains and VL domains for each of antibodies NORI-001 to NORI-033 are shown in Table S. Full IgG4PE heavy chain for each antibody is shown. Full light chain for each antibody is also shown. Unless the context dictates otherwise, "NORI-001" refers to an antibody with the VH and VL domain shown for NORI-001 in Table S. Format of the antibody may be indicated, for example "NORI-001 IgG" is an IgG having the NORI-001 VH domain and the NORI-001 VL domain, and "NORI-001 scFv" is an scFv having the NORI-001 VH domain and the NORI-001 VL domain.

Antibody NORI-002 was ascertained to have a high-risk free cysteine liability in the VH domain. Although thought to be buried through analysis in structural software, this amino acid was mutated to mitigate any potential liability. Therefore, the C49C mutation was introduced into NORI-002, and the new antibody including this mutation was designated NORI-003.

Antibody NORI-010 was sequence optimised for improved stability and expression by introducing a P124S mutation into the VH domain, creating the new antibody NORI-011.

Example 3—Inhibition of MTP-2 in Protein-Based Enzymatic Assay with MTP-2 ECD Antibodies were assessed for their ability to inhibit serine protease cleavage of a labelled MTP-2 substrate to generate a detectable product in an enzymatic assay with human and mouse MTP-2 ECD.

Antibodies NORI-001 to NORI-034 all inhibited enzymatic activity of both human and mouse MTP-2 in this assay. IC50 values for inhibition of human MTP-2 ranged from approximately 1.5 to 55 nM. IC50 values for inhibition of mouse MTP-2 ranged from approximately 0.48 to 40 nM. Table D. FIG. 3.

TABLE D

Potency of antibodies NORI-001 to NORI-034 for inhibiting MTP-2 enzymatic activity in protein and cell-based assays, expressed as IC50 values. Where no value is shown for the cell-based assay, that antibody was not tested in the assay.

| Antibody | Inhibition enzymatic activity human MTP2 protein (IC50) | Inhibition enzymatic activity mouse MTP2 protein (IC50) | Inhibition enzymatic activity human MTP2 on cells (IC50) |
|---|---|---|---|
| NORI-001 | 1.013E−08 | 1.243E−08 | — |
| NORI-002 | 8.534E−09 | 1.617E−08 | — |
| NORI-004 | 5.898E−09 | 2.244E−08 | — |
| NORI-005 | 5.95E−09 | 1.27E−08 | — |
| NORI-006 | 8.797E−09 | 2.295E−08 | — |
| NORI-007 | 8.787E−09 | 3.927E−08 | — |
| NORI-008 | 8.28E−09 | 1.497E−09 | 8.387E−11 |
| NORI-009 | 5.554E−08 | 1.764E−08 | 5.681E−09 |
| NORI-010 | 1.774E−08 | 9.764E−09 | 3.509E−09 |
| NORI-012 | 2.116E−08 | 1.151E−08 | 4.259E−09 |
| NORI-013 | 5.63E−09 | 3.594E−09 | 6.186E−10 |
| NORI-014 | 1.18E−08 | 8.499E−09 | 5.319E−10 |
| NORI-015 | 5.511E−09 | 5.704E−09 | — |
| NORI-016 | 1.038E−08 | 9.274E−09 | — |

TABLE D-continued

Potency of antibodies NORI-001 to NORI-034 for inhibiting MTP-2
enzymatic activity in protein and cell-based assays, expressed
as IC50 values. Where no value is shown for the cell-based
assay, that antibody was not tested in the assay.

| Antibody | Inhibition enzymatic activity human MTP2 protein (IC50) | Inhibition enzymatic activity mouse MTP2 protein (IC50) | Inhibition enzymatic activity human MTP2 on cells (IC50) |
|---|---|---|---|
| NORI-017 | 1.513E−09 | 4.893E−10 | 1.982E−10 |
| NORI-018 | 2.122E−09 | 5.89E−10 | 2.219E−09 |
| NORI-019 | 1.543E−09 | 9.109E−10 | 9.775E−11 |
| NORI-020 | 1.717E−09 | 1.438E−09 | 1.462E−10 |
| NORI-021 | 2.705E−09 | 1.903E−09 | 8.206E−09 |
| NORI-022 | 4.358E−09 | 2.977E−09 | 7.653E−10 |
| NORI-023 | 5.453E−09 | 2.916E−09 | 1.317E−08 |
| NORI-024 | 1.051E−08 | 6.799E−09 | 8.043E−09 |
| NORI-025 | 3.269E−09 | 6.209E−09 | 1.879E−09 |
| NORI-026 | 5.11E−09 | 6.223E−09 | 8.17E−10 |
| NORI-027 | 2.491E−08 | 4.082E−08 | 1.686E−08 |
| NORI-028 | 1.182E−08 | 8.957E−09 | 3.846E−09 |
| NORI-029 | 2.005E−09 | 9.354E−09 | 2.429E−10 |
| NORI-030 | 1.884E−09 | 6.659E−09 | 2.274E−10 |
| NORI-031 | 1.028E−08 | 0.000000027 | 3.506E−09 |
| NORI-032 | 1.596E−09 | 7.156E−10 | 1.656E−09 |
| NORI-033 | 2.843E−09 | 1.735E−09 | 2.06E−10 |
| NORI-034 | 1.088E−08 | 4.689E−09 | 1.393E−09 |

Cross-reactivity of an antibody was assessed by comparing its inhibition in an assay with human MTP-2 ECD against its inhibition in an assay with mouse MTP-2. By plotting percentage inhibition values in the two assays against each other, it could be observed that some antibodies were specific for human MTP-2 while others were specific for mouse MTP-2 and that there were varying degrees of inhibition against both human and mouse MTP-2. FIG. 4.
Materials and Methods for Protein Based Enzymatic Assay For initial assays, positive and negative controls, aprotinin (Sigma—A3428) and non-MTP-2 binding huIgG4PE isotype antibody respectively, were serially diluted 1:3 in assay buffer (200 mM Tris HCl and 1 mg/mL BSA, pH 9.0) at 2× final concentration with a starting concentration of 200 nM. In later assays, the positive and negative controls used were NORI-008 huIgG4PE and a non-MTP-2 binding huIgG4PE isotype antibody at 10 nM respectively.

20 μl of titrated controls and diluted antibodies were plated into 384-well solid white plates (Alpha plate—6005350) and 10 μl of human or mouse MTP-2 ECD protein was plated on top, final concentration of 0.5 or 2 mg/ml respectively, due to differences in enzymatic activity. The plates were then covered and incubated for 30 minutes at room temperature. 10 μl of fluorescent MTP-2 peptide substrate Boc-Gln-Gly-Arg-AMC (Bachem AG—4016429.0050) was then added to each well at a final concentration of 50 μM in assay buffer. The enzymatic reaction was left to proceed at room temperature and the fluorescent activity was then read on a plate reader (Envision) at 30 minutes, 1 hour and 2 hours with an excitation wavelength of 360 nm and emission wavelength of 460 nm. Upon cleavage of the substrate peptide via enzymatic activity of MTP-2 enzyme, the 7-Amido-4-methylcoumarin (AMC, MCA, or NHMec) moiety is released from the C-terminus. AMC is a fluorophore incorporated C-terminally into carboxypeptidase substrates. Excitation of the released coumarin can then occur using a spectrofluorometer via excitation at 360-380 nm and detecting the emission at 440-460 nm. Positive and negative controls were taken as an average of 16 wells of aprotinin/NORI-008 IgG and huIgG4PE isotype at 200 nM final concentration respectively. Log curves were generated by inputting inhibitory values into graphpad software and IC50 values generated using the nonlinear regression parameters and the log (inhibitor) vs response—Variable slope (four parameters) equation.

For production details of antigen reagents see Example 5.

Example 4—Inhibition of MTP-2 in Cell-Based Enzymatic Assay with Cell-Surface Expressed MTP-2

Antibodies were assessed for their ability to inhibit serine protease cleavage of a labelled MTP-2 substrate to generate a detectable product in an enzymatic assay with cell surface expressed human MTP-2.

Figure 5:
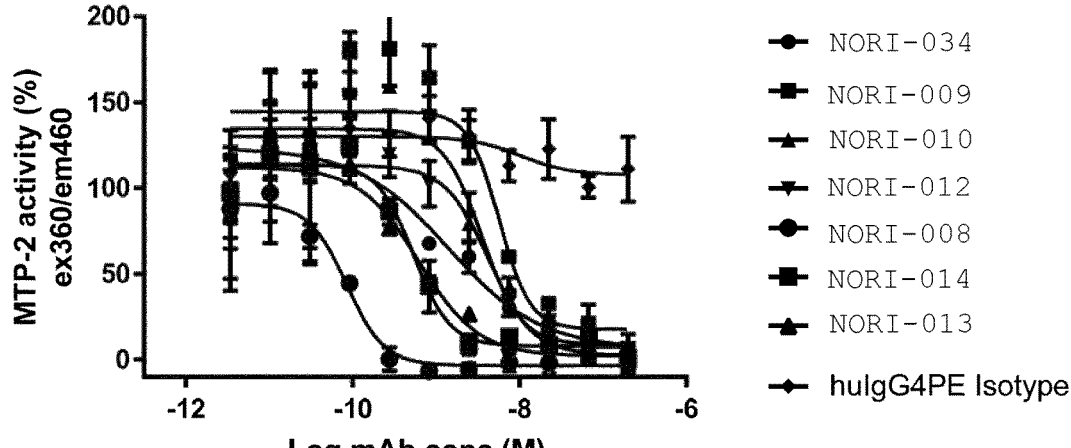
FIG. 5 shows full dose response curves for selected anti-MTP-2 antibodies and a negative control antibody in a cell-based enzymatic assay with human MTP-2 ECD. All antibodies are isotype human IgG4PE.

Antibodies NORI-008 to NORI-010, NORI-012 to NORI-014 and NORI-017 to NORI-034 all inhibited enzymatic activity of human MTP-2 in this assay. IC50 values for inhibition of human MTP-2 ranged from approximately 0.083 nM to 17 nM. Table D. FIG. 5.

Figure 2:
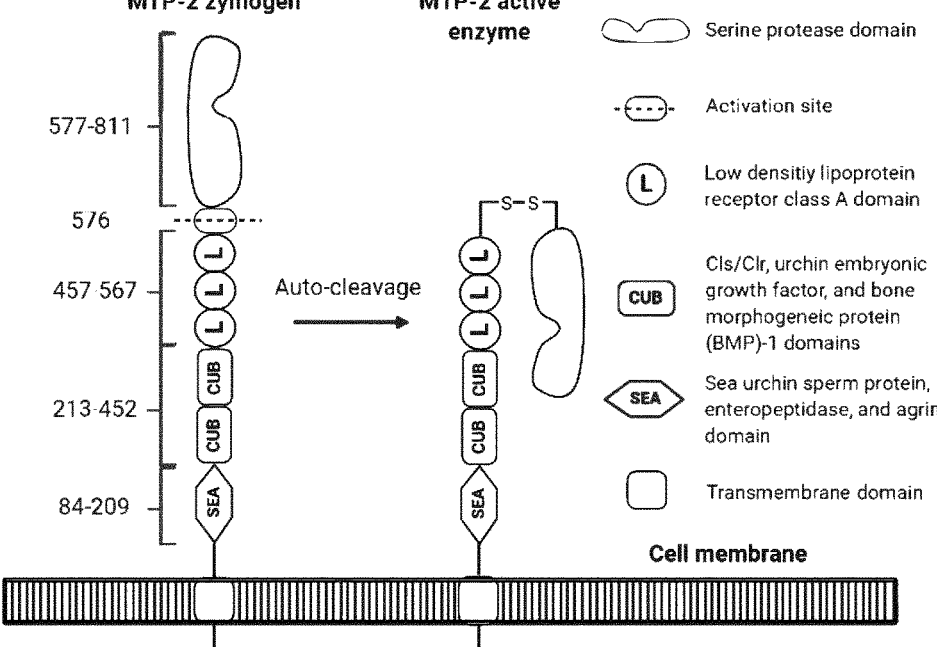
FIG. 2 shows the domain structure of MTP-2.

In this cell-based assay, MTP-2 is being expressed by the cells and displayed on the cell surface, where it undergoes auto-activation to generate the activated MTP-2 which cleaves its substrate. Inhibitors in this assay may act by a variety of molecular mechanisms. For example, an inhibitor that shows inhibition in this assay may be binding to and inhibiting conversion of the MTP-2 zymogen into auto-activated MTP-2 (FIG. 2), thereby preventing formation of the activated form of MTP-2 which otherwise cleaves its substrate in this assay, and/or an inhibitor in this assay may be binding to and inhibiting the activated form of MTP-2.

Ability of the antibodies NORI-001 to NORI-034 to inhibit cell-surface expressed MTP-2 confirms their activity against MTP-2 in a cell-based setting in which the target antigen is undergoing expression and activation on cells, which are features of the situation in vivo.

Materials and Methods for Cell-Based Based Enzymatic Assay

All antibodies for screening plus positive and negative controls were serially diluted 1:3 in Expi293 media (A1435101)—serum free media, pH 8, with high glucose and GlutaMAX added—at 2× final concentration with a starting concentration of 200 nM. 12.5 μl of antibodies (protein A purified) and controls were plated into 96-well solid white plates (Corning—CLS3917-100EA) and 25 μl of cells in Expi293 media (6250 cells per well) dispensed on top. 12.5 μl of fluorescent MTP-2 peptide substrate (Bachem AG —4016429.0050) was then added to each well at a final concentration of 50 μM in Expi293 media. The enzymatic reaction was left to proceed overnight in an incubator at 37° C. and 5% $CO_2$. The next day the fluorescent activity was read on a plate reader (Envision) with an excitation wavelength of 360 nm and emission wavelength of 460 nm. Positive and negative controls were taken as an average of 4 wells of aprotinin and huIgG4PE isotype at 200 nM final concentration respectively.

For initial assays the positive control was aprotinin (Sigma—A3428). For later assays the positive control was NORI-008 huIgG4PE. A non-MTP-2 binding huIgG4PE isotype antibody was used as negative control.

For production details of antigen reagents see Example 5.

Example 5—Preparation of Antigen Materials

Generation of Constructs for Protein Expression

To generate purified proteins for use in assays described herein, we used DNA sequences encoding:

Extra-cellular domain (ECD) of WT human matriptase-1 (uniprot seq ID no: Q9Y5Y6) aa 77-855

Wild-type (WT) human MTP-2 (uniprot seq ID no: Q8IU80) aa 78-811

WT mouse MTP-2 (uniprot seq ID no: Q9DBI0) aa 80-811

WT rat MTP-2 (NCBI seq ID: XP006242057.1) aa 80-811

Cynomolgus MTP-2 (uniprot seq ID no: A0A2K5VAP0) aa 73-800

The above amino acid sequences are also provided for reference in Table S.

These coding sequences were fused with a C-terminal His tag and N-terminal leader sequence, codon optimised for mammalian expression and expressed.

To generate MTP-2 antigens, expression can be greatly improved through co-expression with untagged moHAI-2 ECD antigen, followed by purification of His tagged antigen via a nickel column. For this purpose, DNA encoding WT mouse HAI-2 (uniprot seq ID no: Q9WU03) aa 28-197 was fused with an N-terminal immunoglobin leader sequence, codon optimised for mammalian expression and expressed.

DNA sequences were cloned into a pTT5 protein expression vector under the control of the CMV promoter using golden gate and AarI restriction sites. Expression plasmids were transfected into CHO-3E7 cells using PEI transfection reagent.

Generation of Full-Length Antigen Constructs for Stable Cell Line Generation

Stable cell lines expressing the relevant antigens were generated for purposes of screening MTP-2 specific antibodies.

Full length DNA sequence encoding for wildtype (WT) human MTP-2 (uniprot seq ID no: Q8IU80) amino acids (aa) 1-811, WT mouse MTP-2 (uniprot seq ID no: Q9DBI0) aa 1-811, each fused to N-terminal eGFP and C-terminal flag tag (DYKDDDDK), were codon optimised for mammalian expression. This process was repeated for cynomolgus MTP-2 (uniprot seq ID no: A0A2K5VAP0) aa 1-800 untagged. DNA sequences were cloned into an expression vector under the control of the CMV promoter flanked by 3' and 5' piggyBac specific terminal repeat sequences, which facilitated stable integration into the cell genome (see: "A hyperactive piggyBac transposase for mammalian applications"; Yusa K., et al., Proc. Natl. Acad. Sci. USA, 108(4): 1531-6, 2011 Jan. 25). The CMV promoter expression vector contained a puromycin selection cassette to facilitate stable cell line generation.

Isoform 2, untagged versions of WT human MTP-2 aa 10-811 and WT mouse MTP-2 amino acids 13-811 were generated by PCR-directed mutagenesis from the constructs above and re-cloned into the same expression vector as before. Isoform 2, untagged versions of K253E, V736A and K253E+V736A human WT MTP-2 (uniprot seq ID no: Q8IU80) sequence aa 10-811 variants were also generated by PCR-directed mutagenesis and re-cloned into the same expression vectors as before.

Full length DNA sequence encoding WT human matriptase-1 (MTP-1) (uniprot seq ID no: Q9Y5Y6) aa 1-855 with C-terminal His tag fusion, WT human matriptase-3 (MTP-3) (uniprot seq ID no: Q7RTY8) aa 1-854 with C-terminal His tag fusion and untagged WT mouse HAI-2 (uniprot seq ID no: Q9WU03) aa 1-252 were all codon optimised for mammalian expression cloned into the same expression vector as before with CMV promoter. The expression vectors for MTP-1 and MTP-3 contained a puromycin selection cassette while the expression vector for moHAI-2 contained a neomycin selection cassette to facilitate dual stable cell line generation.

Generation of Stably Transfected Hepa 1-6, CHO and HEK-293 Cells Expressing MTP-1, MTP-2 and MTP-3 Antigens For generation of human embryonic kidney (HEK)-293 cell lines expressing WT human MTP-2 eGFP/Flag tagged aa 1-811, the CMV promoter expression plasmids were co-transfected with a plasmid encoding piggyBac transposase into human embryonic kidney (HEK)-293 cells using the FreeStyle Max transfection reagent (Invitrogen) according to manufacturer's instructions.

For generation of chinese hamster ovary (CHO) cell lines expressing WT human MTP-2 eGFP/Flag tagged aa 1-811, the CMV promoter expression plasmids were co-transfected with a plasmid encoding piggyBac transposase into chinese hamster ovary (CHO) cells using the FreeStyle Max transfection reagent (Invitrogen) according to manufacturer's instructions.

For generation of cell lines expressing untagged, WT human MTP-2 aa 10-811 and WT mouse aa 13-811 MTP-2, the CMV promoter expression plasmids were co-transfected with a plasmid encoding piggyBac transposase into HEK293. WT human aa 10-811 and WT mouse aa 13-811 MTP-2 untagged constructs were also co-transfected with a plasmid encoding piggyBac transposase into the Hepa 1-6 cell line using the FreeStyle Max transfection reagent (Invitrogen) according to manufacturer's instructions.

For generation of cell lines expressing His tagged, WT human MTP-1 aa 10-855 and WT human MTP-3 aa 1-854, the MTP-1 and MTP-3 CMV promoter expression plasmids were co-transfected with the WT moHAI-2 expression plasmid and a plasmid encoding piggyBac transposase into HEK293 cell line using the FreeStyle Max transfection reagent (Invitrogen) according to manufacturer's instructions.

Twenty-four hours after transfection, the media was supplemented with puromycin (2.5 µg/mL) or G418 (1 mg/mL) or both puromycin (2.5 µg/mL) and G418 (1 mg/mL) and grown for at least two weeks to select stable cell lines. Cell culture medium was replaced every 3-4 days. Following selection, WT human MTP-2 eGFP/Flag tagged aa 1-811 expressing HEK293 cell lines were serially diluted into a monoclonal cell line for highest expression. This was repeated for WT and S762A human MTP-2 eGFP/Flag tagged aa 1-811 expressing CHO cell lines. Expression of flag tagged human or mouse MTP-2 constructs on cells was assessed by flow cytometry using an anti-flag APC conjugated antibody (Biolegend—637308) while the expression of his tagged human MTP-1, human MTP-3 and human and mouse MTP-2 constructs was assessed by flow cytometry using an unlabelled anti-His primary antibody (Abcam—ab18184) followed by a goat anti-mouse 647 conjugated secondary antibody (Citeab—115-605-071). Following selection, stable untagged WT human MTP-2 and WT mouse MTP-2 expressing HEK293 cells and stable untagged WT human MTP-2 and WT mouse MTP-2 expressing Hepa 1-6 cells were FACS sorted for high expression. Expression of untagged human, mouse and cyno MTP-2 constructs on cells, including human and mouse mutants and human variant constructs, was assessed by flow cytometry using an APC conjugated anti-MTP-2 antibody.

Complete HEK293 and Hepa 1-6 media was made up of Dulbecco's Modified Eagle's Medium (Gibco) supplemented with 10% v/v fetal bovine serum (Gibco). During transfection, adherent CHO cells were cultured in Ham's F-12 Nutrient Mix (Gibco) supplemented with 10% v/v fetal bovine serum (Gibco). Following transfection, antigen expressing CHO cells were cultured in suspension with complete CHO-S media which was made up of CD-CHO media supplemented with 8 mM Glutamax (Gibco). CHO-3E7 cell used for expression here included the pTT5 vector system and CHO EBNA 1 cells available from the National Research Council of Canada, but other CHO cell lines could be employed.

Example 6—Surface Plasmon Resonance Determination of Binding Affinity and Kinetics Off-rate screening was performed by surface plasmon resonance (SPR), using a Biacore 8K system (GE Healthcare). Anti-human Fc mix (~1000 RU) were immobilised in both active and reference channels in HBS-P+ buffer (GE BR100671) pH 7.4. Anti-MTP-2 huIgG4PE antibodies were then captured for 60 sec at 10 µl/min at 1 µg/ml concentration (approximatively 35 and 50 RU were captured) only on the active channel. MTP-2 ECD protein analytes were then injected (at 100, 25, 6.25, 1.56 and 0 nM concentrations) for 120 sec (association time) at 30 µl/min and dissociation monitored for 600 sec. Multiple cycle kinetics mode was used with all 8 channels being used. Reference and background were subtracted from the sensorgrams for each antibody and data was fitted using a 1:1 interaction model in the Biacore evaluation software. Rmax, ka, kd globally fitted, RI=0.

Affinity ($K_D$) for the tested antibodies ranged from approximately 0.012 nM to 8.5 nM. Table K.

TABLE K

| Antibody | Capt Lev | Binding Late top conc | Stoichiometry | ka (1/Ms) | kd (1/s) | KD (M) | Rmax (RU) |
|---|---|---|---|---|---|---|---|
| | | | | Human MTP2 | | | |
| NORI-034 | 31.1 | 16.9 | 0.48 | 7.94E+05 | 1.26E−04 | 1.58E−10 | 16.6 |
| NORI-009 | 28.9 | 8.6 | 0.48 | 7.48E+04 | 1.12E−03 | 1.50E−08 | 15.5 |
| NORI-010 | 29.8 | 7.9 | 0.63 | 4.23E+04 | 4.42E−04 | 1.05E−08 | 20.6 |
| NORI-012 | 31.2 | 8.5 | 0.60 | 4.67E+04 | 4.27E−04 | 9.13E−09 | 20.9 |
| NORI-014 | 43.1 | 10.7 | 0.90 | 2.69E+04 | 4.60E−05 | 1.71E−09 | 42.8 |
| NORI-013 | 44.1 | 14.6 | 1.05 | 3.22E+04 | 5.78E−05 | 1.79E−09 | 51.3 |
| NORI-008 | 45.0 | 35.8 | 0.72 | 1.14E+06 | 1.47E−05 | 1.29E−11 | 36.0 |
| | | | | Mouse MTP2 | | | |
| NORI-034 | 31.1 | 15.3 | 0.52 | 1.77E+05 | 1.12E−03 | 6.33E−09 | 18.0 |
| NORI-009 | 28.9 | 5.0 | 0.47 | 3.54E+04 | 6.93E−04 | 1.96E−08 | 15.0 |
| NORI-010 | 29.8 | 4.5 | | 1.33E+04 | 3.24E−04 | 2.44E−08 | 30* |
| NORI-012 | 31.2 | 4.6 | 1.08 | 1.16E+04 | 3.37E−04 | 2.90E−08 | 37.2 |
| NORI-014 | 43.1 | 5.4 | 0.93 | 1.21E+04 | 1.00E−05* | 8.30E−10* | 44.2 |
| NORI-013 | 44.1 | 7.5 | 1.47 | 1.05E+04 | 1.00E−05* | 9.49E−10* | 71.8 |
| NORI-008 | 45.0 | 39.2 | 0.86 | 2.37E+05 | 3.05E−05 | 1.29E−10 | 43.1 |

*indicates that the kd (off-rate) for the antibody was too slow and could not be determined with this assay setup. True KD could be < than the value shown.

Binding was also assessed using the above SPR method with "headless" huMTP-2 ECD 78-576 aa instead of the full ECD. Headless ECD corresponds to the MTP-2 ECD without the serine protease domain. The amino acid sequence of the "headless" huMTP-2 ECD 78-576 aa protein corresponds to human matriptase-2 mask ECD protein his tag as shown in the sequence Table S. No binding was detected for any of the 7 antibodies against the headless protein, suggesting the epitope for all these antibodies is in the serine protease domain.

TABLE W

Antibody: antigen binding kinetics of cross-reactive anti-MTP-2 antibodies

| | KD (M) | | | | |
|---|---|---|---|---|---|
| | Human | Mouse | Cyno | Rat | Human headless (no SP) |
| NORI-011 | 5.61E−09 | 9.00E−09 | 2.17E−09 | 3.01E−09 | no significant binding |
| NORI-008 | 1.69E−14 | 2.06E−13 | 1.04E−11 | 7.64E−09 | no significant binding |
| NORI-003 | 5.24E−09 | 2.89E−08 | 1.76E−09 | 1.92E−08 | no significant binding |

TABLE W-continued

Antibody: antigen binding kinetics of cross-reactive anti-MTP-2 antibodies

| | KD (M) | | | | |
| | Human | Mouse | Cyno | Rat | Human headless (no SP) |
| --- | --- | --- | --- | --- | --- |
| NORI-006 | 2.93E−09 | 2.70E−08 | 8.24E−10 | 1.52E−08 | no significant binding |

NORI-011, NORI-008, NORI-003 and NORI-006 were all found to have cross-reactive binding to human, mouse, cyno and rat MTP-2 ECD proteins. The sequences for these proteins as used in the SPR are given by human matriptase-2 ECD protein his tag, mouse matriptase-2 ECD protein his tag, cyno matriptase-2 ECD protein his tag, rat matriptase-2 ECD protein his tag and human matriptase-2 mask ECD protein his tag respectively in sequence Table S. As no binding was detected for any of these 4 antibodies against human matriptase-2 mask ECD protein his tag, this shows the binding is not against his tag and that the epitope for all antibodies is in the serine protease domain. The true KD value for NORI-008 could not be measured accurately for human or mouse MTP-2 due to a very slow off-rate.

Example 7—Binding to MTP-2 Serine Protease Domain

The SPR analysis performed on the panel of antibodies in Example 6 showed that there was no binding detected

Example 8—Competition with Aprotinin

Figure 8:
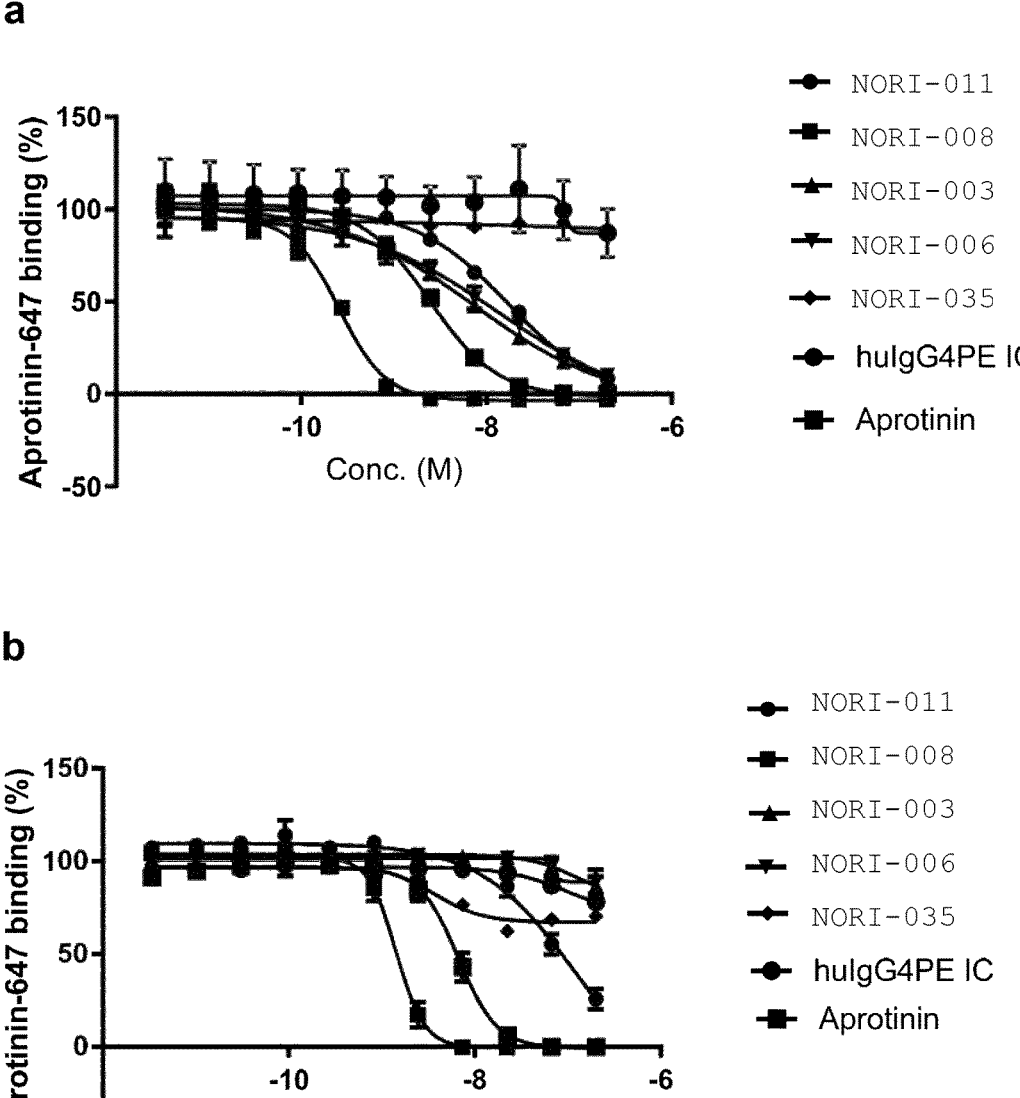
FIG. 8 shows results of HTRF competition assays of selected anti-MTP-2 antibodies or unlabelled aprotinin competing for binding to (a) human and (b) mouse MTP-2 ECD. IC=isotype control against labelled aprotinin-647. All antibodies are human IgG4PE.

Aprotinin is a pan serine protease inhibitor and is known to occupy the active site of serine proteases. A HTRF competition assay against labelled aprotinin confirmed that NORI-003, NORI-006, NORI-008 and NORI-011 were binding at or near this same site and competed with aprotinin for binding to human MTP-2 protein. For NORI-003 and NORI-006 this competition was weak despite a potent enzymatic inhibitory IC50 value against huMTP-2, suggesting the epitope for these clones was perhaps near the active site but not identical to the binding site of aprotinin. This was confirmed by their lack of competition of aprotinin against moMTP-2 while IC50 values in the enzymatic assay were similar to those of NORI-011. NORI-008 displayed a very low Kd value and IC50 value in the SPR and aprotinin competition assay respectively, suggesting its binding site was identical to or closely overlapping with that of aprotinin. FIG. 8. Table L.

TABLE L

Antibody IC50 values for enzymatic inhibition and competition with aprotinin for human and mouse MTP-2.

| Antibody | Inhibition enzymatic activity human MTP2 protein (IC50) | Inhibition enzymatic activity mouse MTP2 protein (IC50) | Competition with labelled aprotinin to human MTP2 protein (IC50) | Competition with labelled aprotinin to mouse MTP2 protein (IC50) |
| --- | --- | --- | --- | --- |
| NORI-011 | 1.139e−008 | 9.876e−009 | 1.703e−008 | 1.197e−007 |
| NORI-008 | 4.455e−010 | 7.572e−010 | 2.564e−010 | 1.415e−009 |
| NORI-003 | 1.605e−009 | 1.903e−008 | 7.276e−009 | No competition |
| NORI-006 | 1.259e−009 | 2.763e−008 | 1.395e−008 | No competition | against the truncated "headless" huMTP-2 protein missing the serine protease domain. This suggests that these antibodies bind the serine protease domain of MTP-2. Such antibodies may be expected to mechanistically block MTP-2 through blocking or distorting the serine protease domain active site, preventing cleavage of substrates.

Figure 6:
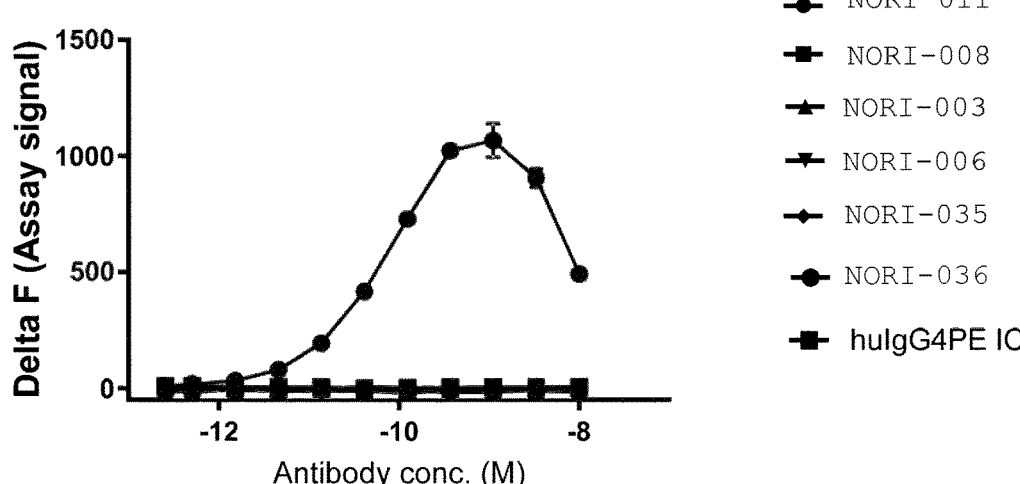
FIG. 6 shows results of HTRF assay for antibodies binding to headless human MTP-2 ECD (recombinant MTP-2 ECD missing the serine protease domain). IC=isotype control. All antibodies are human IgG4PE.
Figure 7:
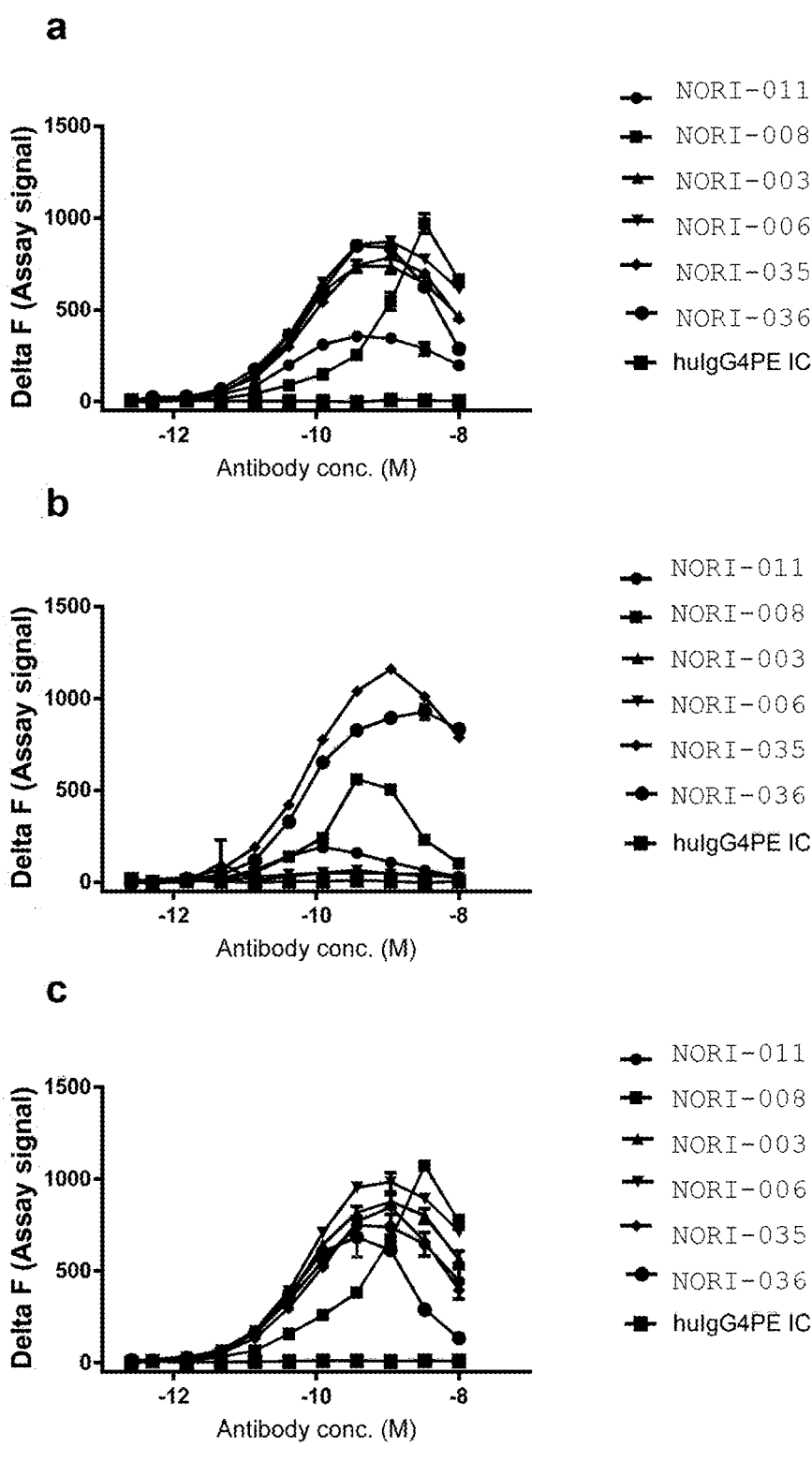
FIG. 7 shows results of HTRF assay for antibodies binding to wild-type (a) human, (b) mouse and (c) cynomolgus MTP-2 ECD. IC=isotype control. All antibodies are human IgG4PE.

An HTRF binding assay of NORI-003, NORI-006, NORI-008 and NORI-011 was performed against this headless protein and confirmed no detectable binding (FIG. 6) while binding was detected against all human, mouse and cynomolgus MTP-2 proteins without C-terminal truncation (FIG. 7). This again suggested the binding epitope for these inhibitory antibodies is in the serine protease domain. Another antibody, NORI-036, bound both headless and full ECD, indicating that it recognised a binding site on MTP-2 outside the serine protease domain.

Materials and Methods for HTRF Competition Assay

Antibodies were titrated into HTRF buffer (DPBS (Gibco—14190144) with 0.1% BSA (Sigma—A7906) and potassium fluoride 0.53M (Sigma—60240-250 G)) at 4× conc with a starting concentration of 200 nM. 5 μL/w of antibodies were added to 384-well white plates (Greiner—784904). Purified proteins of huMTP-2 and moMTP-2 were diluted into HTRF buffer (huMTP-2=40 nM and moMTP-2=240 nM) 4× final conc and plate 5 μL/w. Anti-MTP-2 mAb (NORI-037) in molgG1 backbone was then diluted to 1.2 nM 4× final conc with DELFIA Eu-N1 Rabbit Anti-Mouse-IgG antibody (AD0207) at a 1:1000 dilution 4× final conc in HTRF buffer. Finally, dilute 647-labelled Aprotinin (Sigma—A3428) in HTRF buffer to 20 nM 4× final conc and plate 5 μL/w. Incubate plates for 3 hours or more at RT in the dark. Read plate using HTRF 100 flashes protocol on the EnVision plate reader at 1H 2H and 3H. (Ex: 340 nm Em1: 620 nm Em2: 665 nm).

Example 9—Progression to In Vivo Studies

MTP-2 has been validated as a target to address iron overload anaemia by increasing hepcidin concentrations by various models and concepts. It has been shown by human genetics, in pre-clinical models and in clinical intervention that the absence or blocking of MTP-2 activity can increase hepcidin levels and therefore reduce iron overload. For example, Tmprss6 knock-out mice are viable but characterised by high hepcidin levels and therefore an iron restriction that results in loss of body hair but not around the head area creating a temporary so-called "mask" phenotype. Crossing these mice with beta thalassaemia mice with hemizygote beta globin chain loss, the red blood cell counts and the haemoglobin can be improved due to the increase of hepcidin seen in these crosses (Nai et al., 2012). Furthermore, in humans, mutations in Tmprss6 gene causes a rare form of anaemia where hepcidin levels are abnormally high so that the patients suffer from iron deficiency that cannot be corrected by giving more iron (iron refractory iron deficiency anaemia—IRIDA) (Lenoir et al., Blood 117:647-650 2011; Nai et al., 2012 supra).

Inhibition of MTP-2 activity indicates that an antibody may be capable of increasing hepcidin expression and thus preventing iron overload, which is the main cause of morbidity and mortality in B-thalassaemia. Antibodies for which such activity is confirmed in vivo may thus be able ameliorate anaemia in beta-thalassaemia and be valuable therapeutic agents for treating iron overloaded patients or those at risk of iron overload.

In vivo assessments included assessing the increase in hepcidin gene mRNA transcription from liver cells and a decrease in serum iron in wild-type mice. A readout for this assessment was obtainable within 24 hours of dosing allowing a rapid confirmation of antibody activity.

The desired mechanism of action is to suppress WT MTP-2 enzymatic activity and cleavage of downstream substrates on the cell surface of hepatocyte cells. The immediate impact of this is an observable increase, between 2-8 fold, of hepcidin mRNA transcription within 6 hours of administration. An increase in hepcidin expression leads to a suppression of serum iron, and therefore transferrin saturation within a similar time frame. With continued suppression of MTP-2 and restriction of serum iron in healthy animals there is a decrease in mean corpuscular volume (MCV) and red cell distribution (RDW), which usually begins to manifest after 2 weeks provided the drug remains present and active.

Antibodies chosen for testing in vivo were selected on the basis that they exhibited a concentration dependent inhibition of enzymatic activity for both human and mouse MTP-2 protein and cell-surface expressed MTP-2. Antibodies were excluded if they are were considered to have potential challenges with expression and/or purification yield, posed a developability risk, if full enzymatic inhibition was not observed against human or mouse ECD protein in vitro, or if the IC50 values generated were deemed to be too low.

Two antibodies that showed weak inhibition in the enzymatic assays were also tested in vivo. Both performed very poorly in vivo, supporting the hypothesis that antibodies must have a certain level of inhibition of MTP-2 enzymatic activity in order to perform well in vivo. In vitro inhibition thus appears to be a necessary criterion for in vivo efficacy. Possibly, however, this is not always sufficient for in vivo effect to be achieved. With some antibodies, we observed a strong in vivo performance in the short term but which was not maintained over time. Other factors, such as those relating to pharmacokinetics or anti-drug antibodies generated by the mice, may influence longer term in vivo performance in these models.

Example 10. Protocols for Determining Effects of Anti-MTP-2 Antibodies on Hepcidin mRNA and Serum Iron in Wild Type Mice Iron Assay Protocol To generate the data shown in FIGS. 13, 14, 15, 16, 17 and 18, iron quantification was carried out using the QuantiChrom™ Iron Assay Kit (Bioassay System, DIFE-250).

Briefly, iron standards are prepared according to the kit protocols. Following this, 25 μl of standard or sample is added to the wells on a 96 well plate followed by 200 μl of Reagent A. The plate is then read on a microplate spectrophotometer at 595 nm (Reading A). 10 μl of Reagent B is then added to well followed by 10 μl of Reagent C. The plate is then incubated for 40 minutes at room temperature whereupon it is read on a plate reader at 595 nm (reading B). For all wells the increase in absorbance is calculated by subtracting reading A from reading B. The standard curve is then plotted and the unknown sample iron values read from the standard curve.

To generate the data shown in FIGS. 9, 10, 11, 12 and 19, serum iron content analysis was carried out using an iron direct method measurement (Férène) kit according to the protocol supplied in the kit.

Briefly, 25 μl of standard or serum from the study animals is incubated with 125 μL of solution R1 and 25 μL of solution R2 in a 96 well and the plate is then read on the 600 nm CLF protocol on the envision microplate reader (absorbance A1). 2.5 μl of chromogen is added. After 20 min of incubation at room temperature, the plate is read on the same envision protocol as previously (absorbance A2). Results are calculated by:

$$CLF \text{ mg/L} = 5 - \left(5 \times \frac{(A2 \text{ Serum} - A1 \text{ Serum})}{(A2 \text{ Standard} - A1 \text{ Standard})}\right)$$

$$CLF \text{ μmol/L} = 89 - \left(89 \times \frac{(A2 \text{ Serum} - A1 \text{ Serum})}{(A2 \text{ Standard} - A1 \text{ Standard})}\right)$$

Any values which are calculated as below 0 will be reported as 0.

Calculation of Transferrin Saturation (TSAT)

TSAT analysis is carried out using an iron fixation latency measurement kit according to the protocol supplied in the kit. Briefly, 25 μl of standard or serum from the study animals is incubated with 125 μL of solution R1 in a 96 well plate for 3 min at room temperature. The plate is then read on the 600 nm CLF protocol on the envision microplate reader (absorbance A1). 25 μl of standard or serum from the study animals is incubated with 125 μL of work solution (50:1 volume of R1:R2) for 5 min at room temperature. The plate is then read on the same envision protocol as previously (absorbance A2). Results are calculated by:

$$TSAT = \frac{(A1 - A2) \text{ Serum}}{(A1 - A2) \text{ Standard}} \times \text{Standard concentration} \times 100$$

Any values which are calculated as below 0 will be reported as 0.

Analysis of Serum Antibody Levels

Serum antibody concentrations were ascertained using the following assay: 96 well plates were coated overnight at 4° C. with 50 µL/well of Mouse anti-Human IgG4 Fc (2 µg/mL in PBS). The plates were washed three times with 300 µL/well of PBD-T (PBS plus 0.1% Tween) using the plate washer. Plates were blocked for 1 hour at room temperature using 150 µL/well PBS plus 1% BSA. Samples were diluted (using pooled mouse serum), QCs and standard curve (10 point (7.81-2000 ng/ml)) prepared. The plates were then washed three times with 300 µL/well of PBD-T (PBS plus 0.1% Tween) using the plate washer. 50 µL per well of standard curve, sample or QC was added to the assay plate which was then incubated for 1 hr at room temperature shaking at 300 RPM. The plates were then washed three times with 300 µL/well of PBD-T (PBS plus 0.1% Tween) using the plate washer. 50 µL/well of HRP conjugated mouse anti-human kappa diluted 1 in 12000 in PBS plus 1% BSA was added to the plate which was then incubated for 1 hr at RT, shaking at 300 RPM. The plates were then washed three times with 300 µL/well of PBD-T (PBS plus 0.1% Tween) using the plate washer. 100 µL of TMB substrate was added to each well. Incubated for 10 minutes at RT protected from light. 100 µL/well of stop solution (1M sulphuric acid) was then added. The optical density of each well was measured using a microplate reader set to 450 nm with a reference read above 540 nm. The reference reading is subtracted from 450 nm reading. The data was then imported into Softmax Pro and regression was carried out using a 4 PL curve fit with a weighting factor 1/y for the standards with the sample concentration being read off the standard curve.

RNA Extraction

RNA is prepared from the liver samples using a Qiagen RNeasy Plus Mini Kit according to the protocol in the kit. Frozen samples are allowed to defrost on wet ice. Then 600 µl of Buffer RLT Plus is added to the samples. The sample is then homogenised using a plastic pestle. The sample is then tritiated with a 1 ml syringe and a 20 G needle. The sample is then centrifuged, supernatant place in a gDNA elimination spin column in a 2 ml Eppendorf and the pellet discarded. Centrifuge the spin column and tube keeping the flow through and discarding the column. 600 µl of 70% ethanol is then added to the flow-through. 700 µl of the sample is then paced on an RNeasy Spin Column placed in a 2 ml collection tube which is then centrifuged. The flow through is discarded. The spin column is then placed back into the 2 ml collection tube. And 700 µl of Buffer RW1 is added to the spin column. The spin column is then centrifuged and the liquid flow-through discarded. The spin column back into the 2 ml collection tube and 500 µl of Buffer RPE is added to the spin column and the spin column centrifuged. The flow through is discarded and the washing of the column with Buffer RPE repeated as above. Centrifuge for 15 seconds at 8000×g. The spin column into a new 2 ml collection tube and centrifuge at full for 1 minute to dry the membrane. The spin column is placed into a new 1.5 ml collection tube and 30-50 µl of RNase free water is added directly to the spin column membrane. The spin column is centrifuged for 1 minute to elute the RNA. RNA levels in the flow through are estimated using the nanodrop (see below) and the solution is then stored at −20° C. or −80° C.

qPCR Analysis

Following mRNA extraction, mRNA from the liver of each mouse was quantified by nanodrop and all normalised to 5 ng/µl. Briefly, transcript levels of mouse hepcidin (hamp) mRNA was measured by qRT-PCR and normalised to mouse hypoxanthine-guanine phosphoribosyltransferase (HPRT) mRNA housekeeping gene. 5 µl of mRNA extract (25 ng total) was then mixed with 10 µl of QuantiTect probe RT-PCR kit was mixed with 1 µl of 20× hamp FAM probe mix, 1 µl of 20×HPRT VIC probe mix, 0.5 µl of 40× taqman RT enzyme mix, 2.5 µl of RNA free H2O, 20 µl final volume in a 96-well semi-skirted qRT-PCR plate. Settings for the qRT-PCR reaction includes a 15 minute reverse transcription step at 480° C. followed by an activation step of 950° C. for 10 minutes then 40 cycles of 950° C. for 15 seconds and 600° C. for 1 minute. The −ΔCt value was then calculated by subtracting the Ct value of Hamp from HPRT.

Example 11. Single Dose Assessment of 4 IgG/Lambda Anti-MTP2 Antibodies in Normal Mice for Reducing Serum Iron and Transferrin Saturation at 24 h NORI-009, NORI-010, NORI-012 and NORI-034 were included in a first assessment in healthy mice as fully human IgG4λ mAbs. 9 week old C57BL/6 male mice received one intraperitoneal injection antibody at 10 mg/kg (150 µl/mouse) and 5 mice per group. Mice were sacrificed 24 h after injection. As a positive control of hepcidin induction, three 9 week old C57BL/6 male mice were injected with LPS (1 µg/g body weight) and sacrificed 4 hours later. LPS (lipopolysaccharides from *Escherichia coli*) mimics a bacterial infection and so the mice respond by inducing hepcidin expression to lower serum iron. LPS causes an acute inflammatory reaction and serves as a positive control for an agent that is known to cause a maximal hepcidin increase based on the inflammatory reaction. Real time PCR was carried out on the liver tissues for hamp, Id1, Atho8, SMAD7, CRP and Saa3 mRNA. Haematological parameters were also determined. Red blood cell numbers were determined, and haemoglobin measured. Serum iron from all mice was determined and transferrin saturation calculated.

NORI-034 was not seen to increase hepcidin expression above levels seen in isotype control treated mice. On the other hand, NORI-009, NORI-010 and NORI-012 all increased hepcidin expression 24 hours post dose to at least 1 ct value above the average for the group treated with isotype control and equal to that induced by LPS positive control at 4 hours post dose. As a result, the serum iron content in the mice treated with these antibodies decreased to an average concentration below 40 µg/dl. FIG. 9.

This experiment demonstrated the biological relevance of MTP-2 in the BMP/SMAD/hepcidin pathway and showed for the first time that with antibody directed inhibition, serum iron could be lowered in normal mice. As NORI-034 was seen to be inactive in vivo this antibody was not pursued further.

Example 12. Time Course Assessment of NORI-010 Following Single Ip Injection in Normal Mice Antibody NORI-010 was one of the antibodies that showed a preferable profile in Example 11 and it was therefore of interest to determine the effect observed over time. C57BL/6 male mice received one intraperitoneal injection antibody at 10 mg/kg (150 µl/mouse) and 5 mice per group. Groups were 5 mice terminated at 24 h, 72 h, 1 week and 2 weeks. Analysis was the same as in Example 11 but also included haematocrit (HCT), mean corpuscular haemoglobin (MCH) and red cell distribution width (RDW), a measure of cell diameter related to red blood cell volume.

Figure 10:
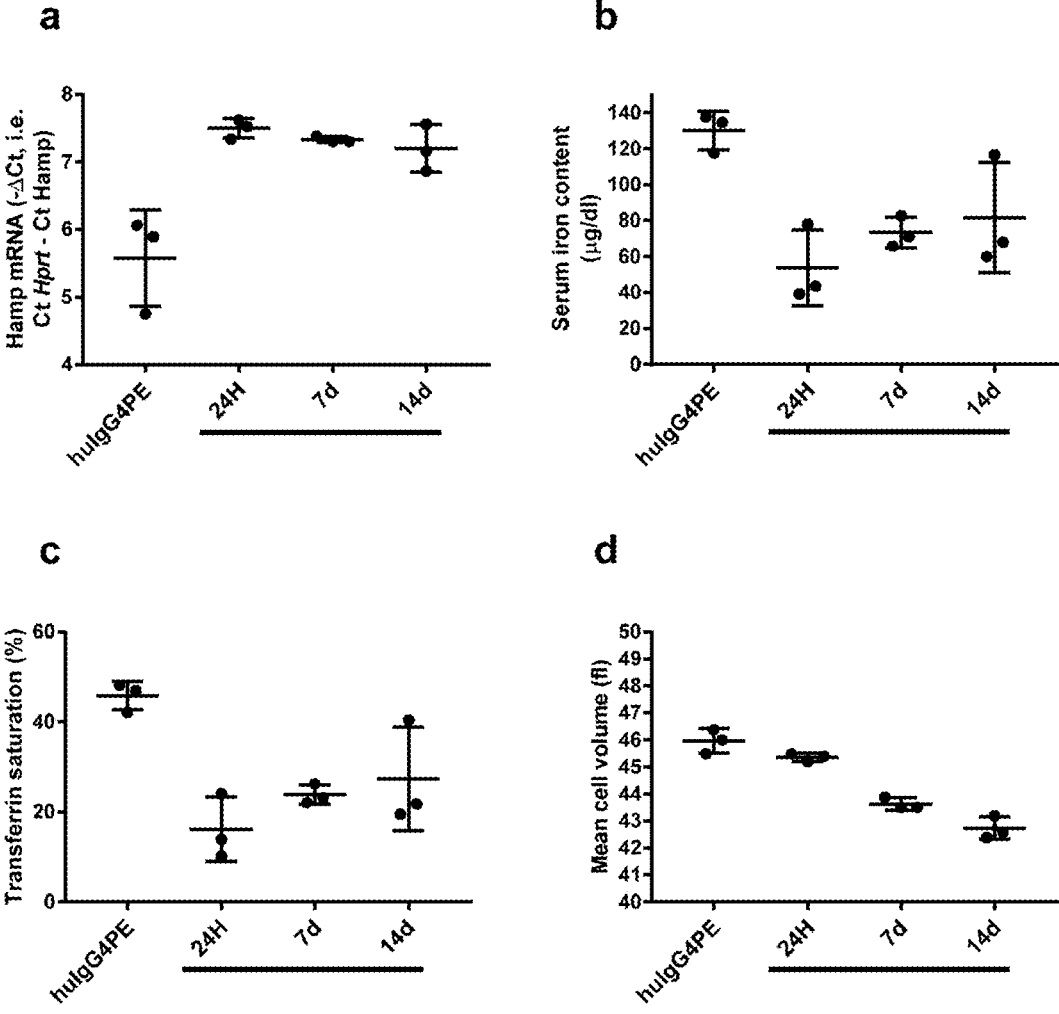
FIG. 10 shows (a) hamp mRNA levels, (b) serum iron levels, (c) TSAT and (d) MCV in wild-type mice treated with 10 mg/kg NORI-010 for 24 h, 7 d and 14 d or with a negative control antibody (single time point).

With administration of 10 mg/kg antibody, hepcidin elevation was maintained for 2 weeks, lowering serum iron and TSAT for the duration. MCV values were decreased due the consistent iron restriction. FIG. 10.

Figure 11:
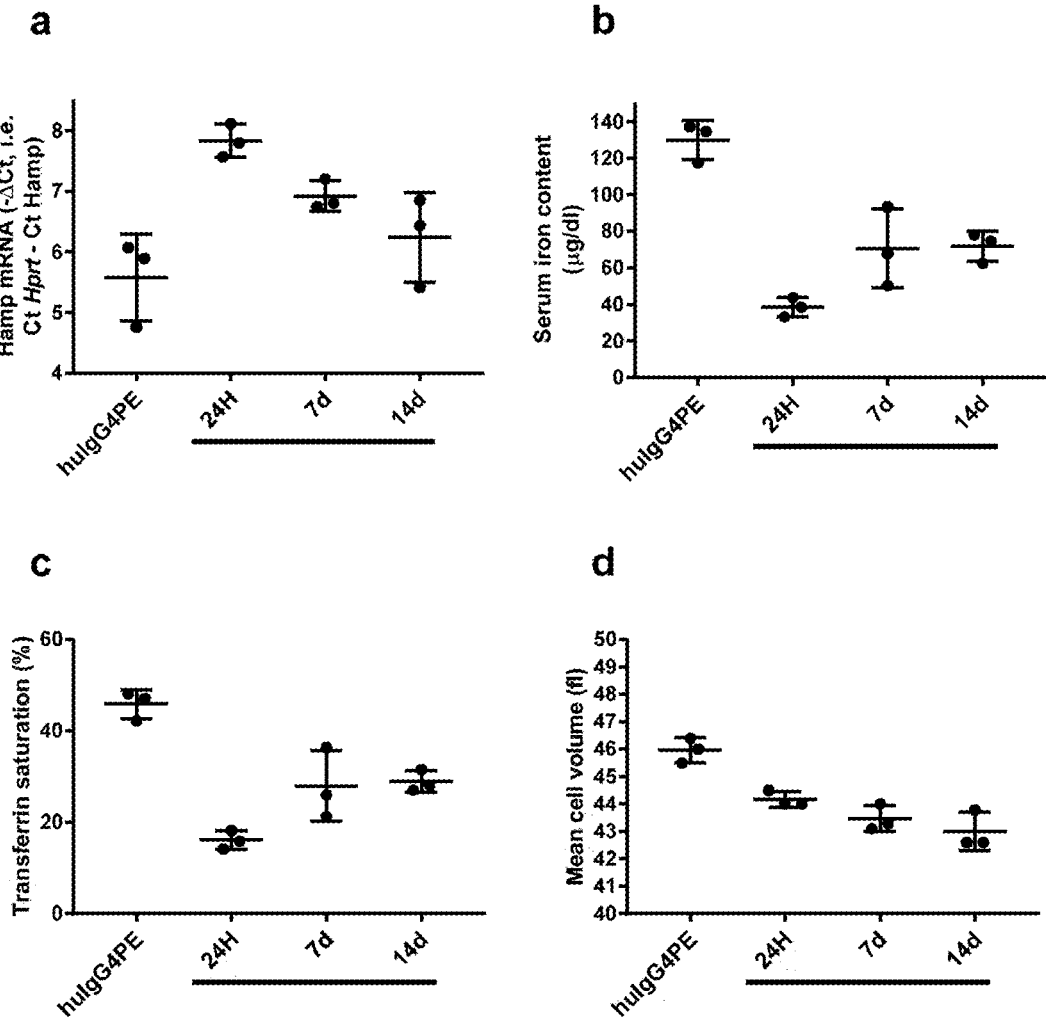
FIG. 11 shows (a) hamp mRNA levels, (b) serum iron levels, (c) TSAT and (d) MCV in wild-type mice treated with 3 mg/kg NORI-010 for 24 h, 7 d and 14 d or with a negative control antibody (single time point).

With administration of 3 mg/kg antibody, the effect on hepcidin elevation was lost by 2 weeks due to the lower dose. Despite this, serum iron and TSAT remained lowered over the 2 weeks and MCV was also decreasing as with the 10 mg/kg dose. FIG. 11.

Example 13. Assessment of Two IgG/Kappa Anti-MTP2 Antibodies and Two IgG/Lambda Anti-MTP-2 Antibodies for Reducing Serum Iron and Transferrin Saturation at 24 h NORI-008 in mouse IgG1 (molgG1) format was assessed for in vivo activity. NORI-010 hulgG4PE was included as a positive control antibody for in vivo anti-MTP-2 activity. NORI-036 and NORI-037 were included as negative control antibodies in the molgG1 and hulgG4PE formats respectively. The latter control antibodies were cross-reactive binders to MTP-2 but did not inhibit enzymatic activity of human or mouse ECD proteins in vitro.

9 week old C57BL/6 male mice received one intraperitoneal injection antibody at 10 mg/kg (150 μl/mouse) and 3-5 mice per group. Mice were sacrificed 24 h after injection. Real time PCR was carried out on the liver tissues for hamp, Id1, Atho8, SMAD7, CRP and Saa3 mRNA. Haematological parameters were also determined. Red blood cell numbers were determined, and haemoglobin measured. Serum iron from all mice was determined and transferrin saturation calculated.

Figure 12:
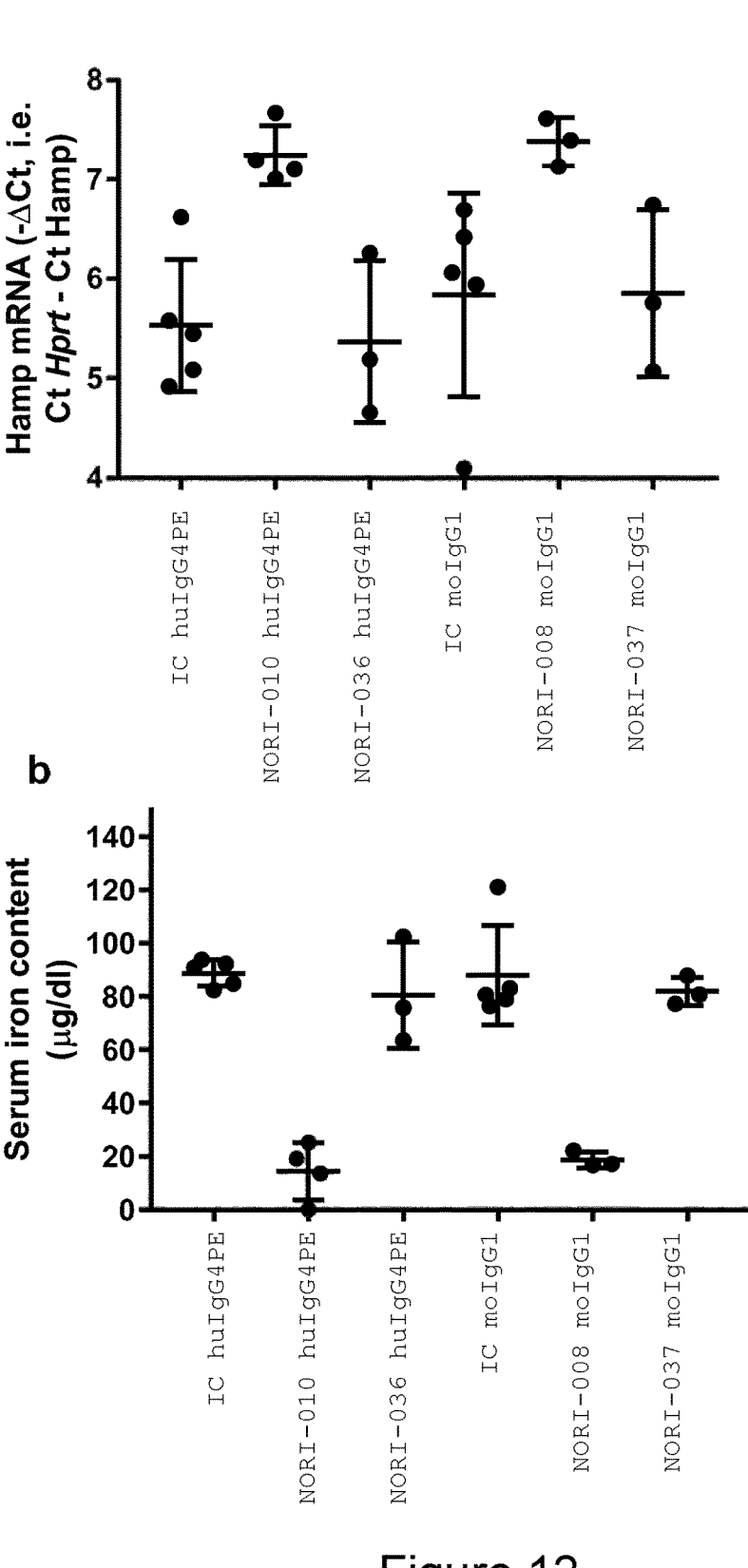
FIG. 12 shows (a) hamp mRNA levels and (b) serum iron levels from mice treated with human or mouse anti-MTP-2 antibodies or their isotype controls.

Here, we find NORI-008, which has very strong affinity to human and mouse MTP-2 is also active in vivo. In comparison to NORI-010, it was found to be as active at the 24 hour timepoint in terms on elevating hepcidin mRNA expression and decreasing the serum iron content. FIG. 12.

This demonstrates that both antibodies are maximally inhibiting MTP-2 activity in vivo. NORI-036 and NORI-037 are binders to MTP-2 but have no effect on hepcidin expression or serum iron in vivo. This demonstrates that the in vitro screening strategy was successful in producing antibodies that can successfully block MTP-2 in vivo to induce a biological response.

Example 14. Time Course Assessment of NORI-008 Following a Single Ip Injection in Normal Mice 10, 3 and 1 mg/kg This experiment shows a dose time relationship following an ip injection of the anti-MTP-2 antibody NORI-008, via changes in serum iron concentration.

Male C57BL6J mice, 22-28 g, n=5/group, were given a single 2, 20 or 200 μg ip injection of the fully human IgG4 anti-MTP-2 antibody, NORI-008. One group received a 200 μg dose of a human IgG4 isotype control antibody and was culled on day 1. The other 9 groups consisted of 3 groups per dose of NORI-008 (2, 20 or 200 μg) with each group being culled on a separate dose. One group of animals treated with each dose was bled on days 1, 7 and 14 and serum iron concentration ascertained to assess the efficacy of NORI-008.

Samples from every dose and time point were then analysed for hepcidin expression in the liver and antibody levels in the serum at day 7 (PK analysis). No antibody was measurable in the 2 μg group at any time point and only three of 5 animals had measurable levels at 24 hours following the 20 μg dose.

Figure 13:
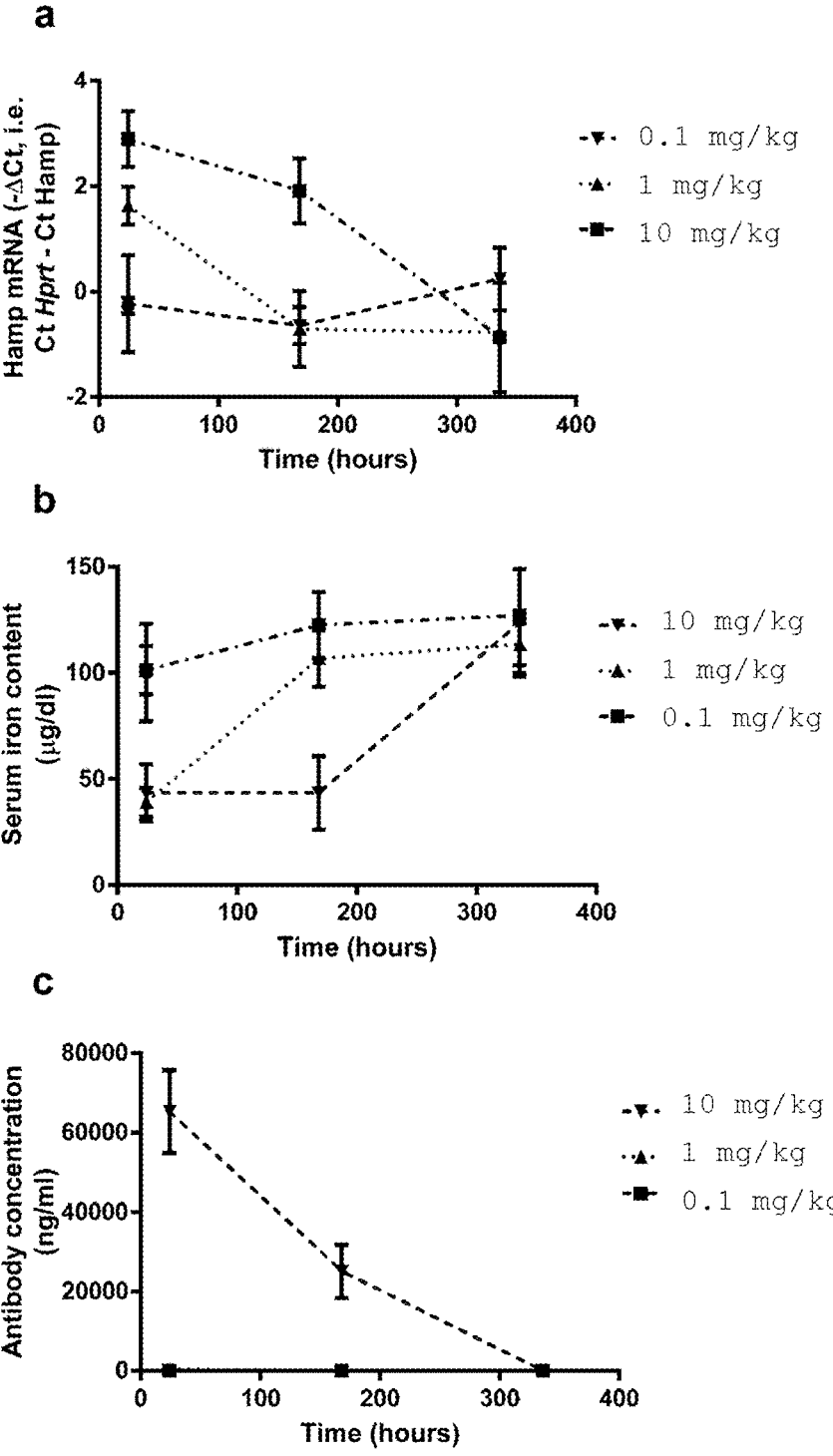
FIG. 13 shows the results of a time course assessment of NORI-008 following a single ip injection in normal mice 10, 3 and 1 mg/kg (a) hamp, (b) serum iron, (c) PK.
Figure 15:
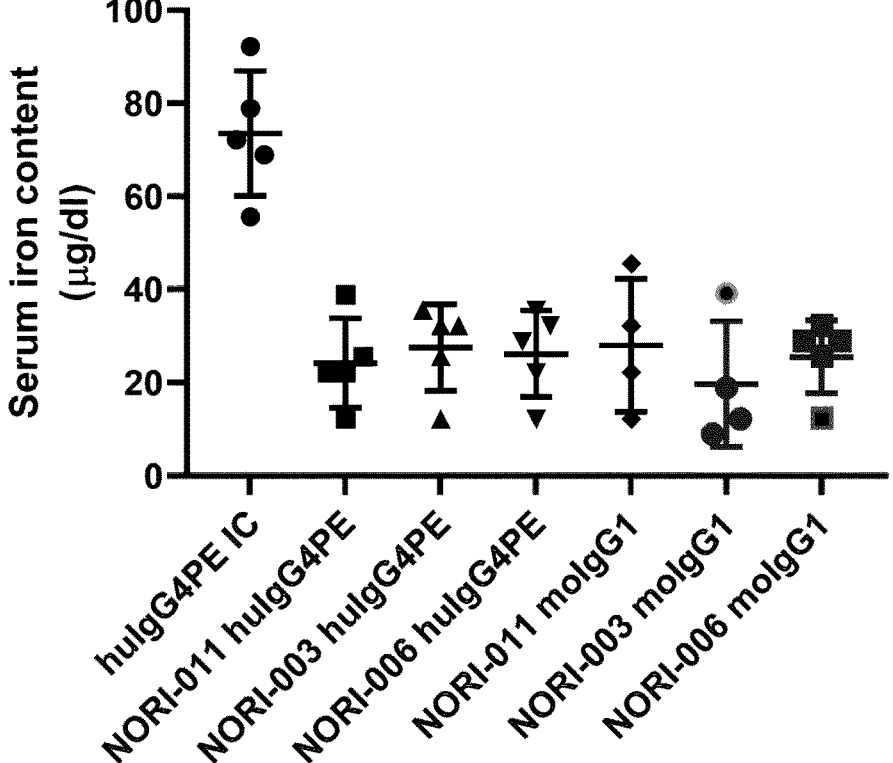
FIG. 15 shows the results of an evaluation of three anti-MTP-2 antibodies in a fully human IgG4 and mouse IgG1 format and for their ability to decrease serum iron concentration following a subcutaneous injection

At 200 μg dose, NORI-008 effect lasted for at least 1 week in vivo before hepcidin expression and serum iron returned to normal at the 2 week timepoint. At the 20 μg dose, the effect lasted for at least 1 day before returning to normal at the 1 week timepoint. With the 2 μg dose, no effect was observed. The duration of effect correlates with PK values for antibody concentration. That is, when the antibody falls below a critical concentration the effect on MTP-2 inhibition is lost and hepcidin expression and serum iron returns to normal. FIG. 13.

Example 15. In Vivo Assessment of Six IgG4/Kappa Anti-MTP2 Antibodies for Reducing Serum Iron and Transferrin Saturation at the 1 Week Timepoint in Normal Mice This study evaluated six fully human IgG4 anti-MTP-2 antibodies for their ability to decrease serum iron concentration following an ip injection.

Male C57BL6J mice, 25-32 g, n=3-5/group, were given a single 10 mg/kg ip injection of fully human IgG4 anti-MTP-2 antibodies. Eight groups were included in the study each animal received a single 10 mg/kg ip dose, of either one of the seven fully human IgG4 PE anti-MTP2 antibodies, NORI-005, NORI-004, NORI-002, NORI-001, NORI-007, NORI-006 and NORI-010, or a human IgG4 isotype control antibody. NORI-010 was added as positive control and benchmark anti-MTP-2 antibody to compare to the other antibodies used in this experiment. All groups apart from the NORI-005 (n=3) and NORI-002 (n=4) contained 5 animals. Animals were bled on days 7 and serum iron concentration was ascertained to assess the iron parameters, hamp mRNA and IgG levels of the anti-MTP-2 antibodies.

All of the antibodies tested showed an increase in hepcidin mRNA expression and therefore a corresponding reduction in serum iron levels. Samples from all the groups tested were then analysed for antibody levels in the serum at day 7 (PK analysis) and showed varying levels of antibody exposure at this timepoint and dose. FIG. 14.

Example 16. In Vivo Assessment of Two IgG/Kappa and One IgG/Lambda Anti-MTP2 Antibodies in Both the hulgG4 and molgG1 Backbone for Reducing Serum Iron at the 1 Week Timepoint (10 mg/kg I.P Dose)

This study evaluated three anti-MTP-2 antibodies in a fully human IgG4 or a mouse IgG1 format for their ability to decrease serum iron concentration following a subcutaneous injection.

Male C57BL6J mice, 25-32 g, n=5/group, were given a single 10 mg/kg sc injection of either fully human IgG4 or molgG1 anti-MTP-2 antibodies. Seven groups were included in the study with either one of three anti-MTP2 antibodies, NORI-011, NORI-003 and NORI-006, as human IgG4 or murine IgG1 or a human IgG4 isotype control antibody. Animals were bled on days 7 and serum iron concentration was ascertained to assess the efficacy of the anti-MTP-2 antibodies.

FIG. 15.

Example 17. In Vivo Assessment Following a Single Intraperitoneal (Ip) or Subcutaneous (Sc) Injection of NORI-010 in Normal Mice with a Readout at 7 Days Post Injection This experiment was to evaluate whether the fully human IgG4 anti-MTP-2 antibody, NORI-010 produced a similar reduction in serum iron concentrations following a subcutaneous injection of 10 mg/kg as that seen with a 10 mg/kg intraperitoneal dose.

Male C57BL6J mice, 23-29 g, n=4-5/group, were given a single 10 mg/kg sc or ip injection of the fully human IgG4 anti-MTP-2 antibody. Two groups received either a single 10 mg/kg ip dose or a single 10 mg/kg sc dose of NORI-010 (n=5 per group). The other two groups received a 10 mg/kg dose of human IgG4 isotype control antibody either ip or sc.

Animals were bled on days 7 and serum iron concentration and IgG levels were ascertained. FIG. 16.

The result of this experiment shows the concentration of antibody in the serum was similar at the 1 week timepoint for both ip and sc methods of dosing. As a result, the serum iron decrease was also similar for both methods of dosing and as seen before, lowered by the MTP-2 inhibition.

Example 18. In Vivo Assessment of the Dose/Time Response Following Single Ip Injection of Anti-MTP-2 Antibody NORI-008 and NORI-010 in Normal Rats This experiment was to evaluate the dose-time relationship of two fully human IgG4 anti-MTP-2 antibodies following an ip injection.

Male wistar rats, 260-320 g, n=3/group, were given a single 3 or 10 mg/kg ip injection of the fully human IgG4 anti-MTP-2 antibodies, NORI-008 and NORI-010. A hIgG4 isotype control antibody (labelled "isotype") was dosed by ip injection at 10 mg/kg as a negative control.

Animals were bled on days 1, 3, 7, 9, 14 and 21. Serum iron and serum antibody concentrations were measured at every time point.

Figure 17:
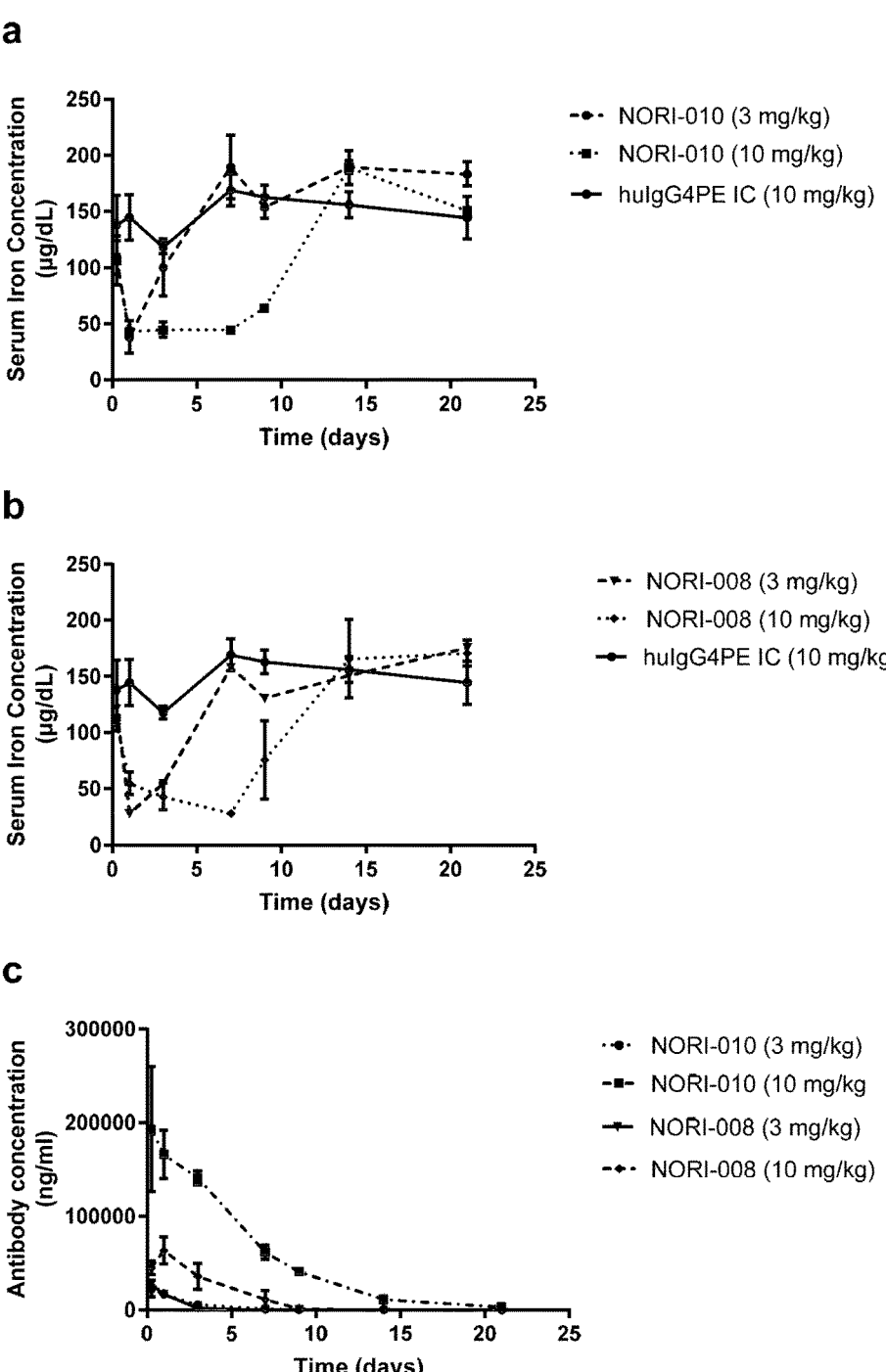
FIG. 17 shows the results of a first in vivo rat study, in which NORI-008 and NORI-010 were dosed at 10 mg/kg IP in groups of 3 wild type Wistar rats.

NORI-010 at 10 mg/kg produced a pharmacological effect and lowered serum iron out to 9 days before returning to normal, whereas at 3 mg/kg the effect lasted for 24 hours only. NORI-008 at 10 mg/kg produced an effect and lowered serum iron out to 9 days before returning to normal, whereas at 3 mg/kg the effect lasted for 72 hours only. The PD of these antibodies correlates well with the IgG serum levels and the iron lowering effect was lost as the antibody concentration decreased. FIG. 17.

Example 19. In Vivo Assessment of the Dose/Time Response Following Single Sc Injection of Anti-MTP-2 Antibodies NORI-003, NORI-006, NORI-008 and NORI-010 in Normal Rats An in vivo assessment was performed of the dose/time response following single sc injection of anti-MTP-2 antibodies in normal rats.

Male wistar rats, 260-320 g, n=5/group, were given a single 10 mg/kg sc injection of the fully human IgG4 anti-MTP-2 antibodies, NORI-003, NORI-006, NORI-008 and NORI-010. A huIgG4 isotype control antibody (labelled "isotype") was dosed at 10 mg/kg as a negative control.

Animals were bled on days 1, 3, 7, 9, 14 and 21. Serum iron and serum antibody concentrations were measured at every time point.

NORI-008 and NORI-010 again showed a duration of effect similar to example 18 with the effect on lowering serum iron lasting out to day 9 before returning to normal. NORI-003 and NORI-006 both showed a more favourable duration of effect with serum iron remaining suppressed for the full 21 days of the study.

The PK analysis of this study indicates the key differences in Cmax of the four antibodies where NORI-003 and NORI-006 have a much higher serum antibody concentration at day 3 compared to NORI-008 and NORI-010. As a result, these two antibodies show a more favourable PK profile and remain above a critical serum antibody concentration for sustaining the inhibition of MTP-2 for much longer. Therefore, the effect on suppressing serum iron is sustained. FIG. 18.

Example 20. In Vivo Assessment in a Mouse Model of Beta Thalassaemia Following a Single Ip Injection of NORI-010

Selected antibody NORI-010 was assessed in a heterozygote murine model of beta thalassaemia intermedia with a heterozygous deletion of b1 and b2 globin genes (Hbbth3/+). The Hbbth3/+ mouse exhibits features similar to beta-thalassaemia intermedia in humans, including Hb levels between 7 and 9 g/dL, aberrant erythrocyte morphology, increased reticulocyte count, ineffective and extramedullary erythropoiesis, hepato-splenomegaly, and liver and spleen iron overload, a complex phenotype which worsens with aging. Following the activity of NORI-010 observed in examples 18-20 this antibody was injected ip at 10 mg/kg and animals terminated 2 weeks after this single dose (n=3 per time point). In addition, one group of animals was analysed after 24 h for hepcidin mRNA. A human IgG4 isotype control antibody was used as a negative control at the same dose.

Results were recorded for the following parameters:
Hepcidin mRNA levels in the liver (24 h and 2 weeks according to method example 10)
Id1 mRNA levels in the liver (24 h and 2 weeks according to method example 10)
Serum iron concentrations (2 weeks according to method example 10)
Calculated transferrin saturation (2 weeks according to method example 10)
Mean corpuscular volume (2 weeks)

Figure 19:
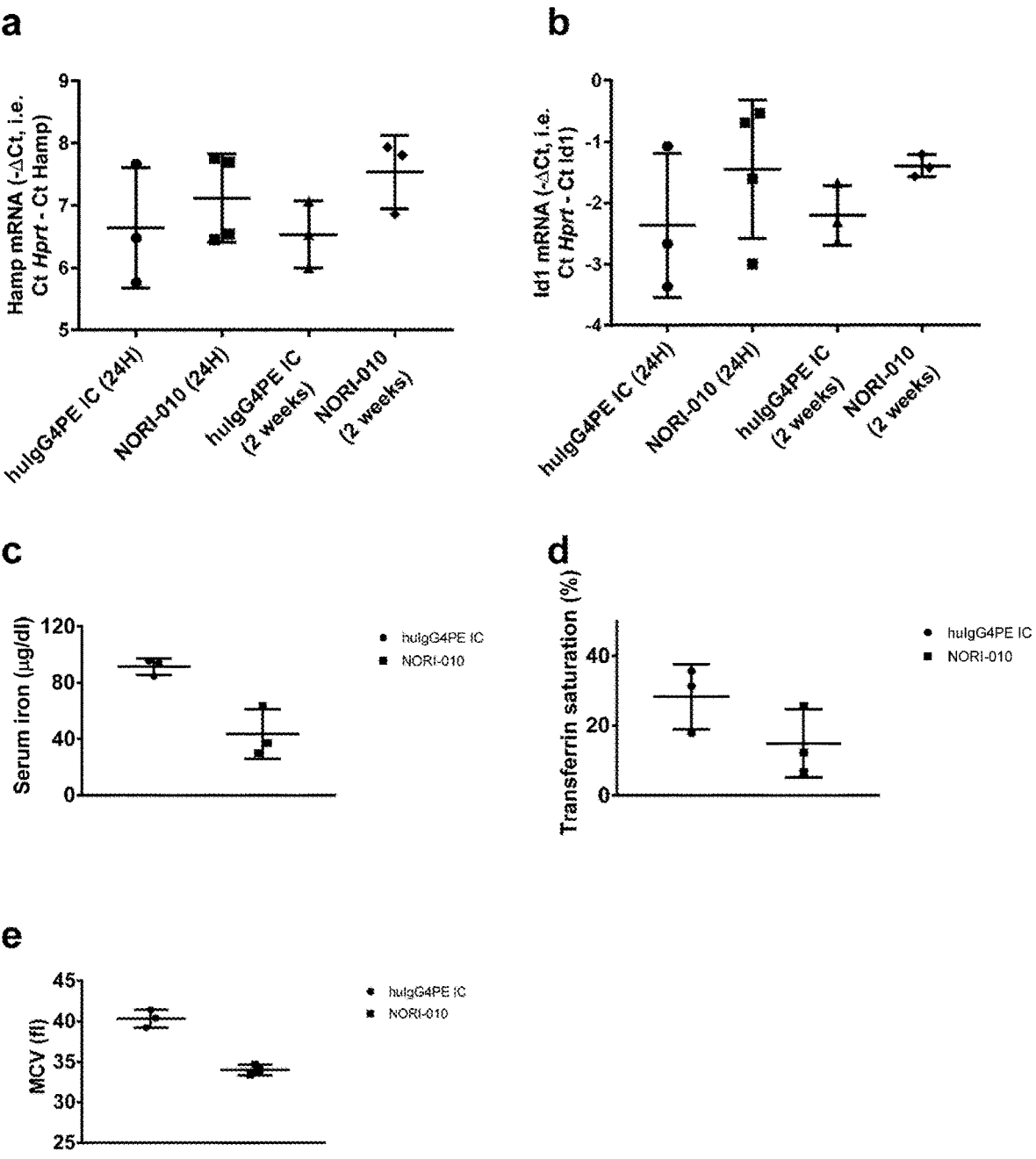
FIG. 19 shows the results for a 2 week study in a Hbbth3/+ mouse model of thalassaemia intermedia with NORI-010. a) hepcidin mRNA measured by qPCR from liver samples, b) serum iron levels as measure by chromogenic assay [µg/dL] and c) calculated transferrin saturation [%].

Results show that on dosing of NORI-010, hepcidin levels were elevated over isotype control at 24 h already. This difference was maintained over the two week period. Concordantly, serum iron levels were reduced around 52% over isotype control and the calculated transferrin saturation was reduced 47% over animals treated with the isotype control at the two week time point. FIG. 19.

Example 21. 8 Week Repeat Dose Assessment of Treatment with NORI-011-M in a Mouse Model of Beta Thalassaemia with and without Co-Treatment with Erythropoietin The aim of this study was to see the effects on haematological parameters after a longer treatment period than in Example 20. For this, Hbbth3/+ mice (n=5/group) were injected intraperitoneally once per week with 10 mg/kg NORI-011-M antibody for 8 weeks. For this longer term repeat dose experiment the isotype of NORI-011 was re-formatted with a murine constant region (murine IgG1 and murine lambda constant regions) to avoid or reduce immunogenicity and the generation of anti-MTP2 antibodies in the mice. In connection with this reformatting, a slight modification was also made to the NORI-011 VH domain C terminal sequence and the modified antibody was renamed NORI-011-M. Sequences for NORI-011-M are shown in Table S. The control used here was a mouse isotype IgG1.

Figure 20:
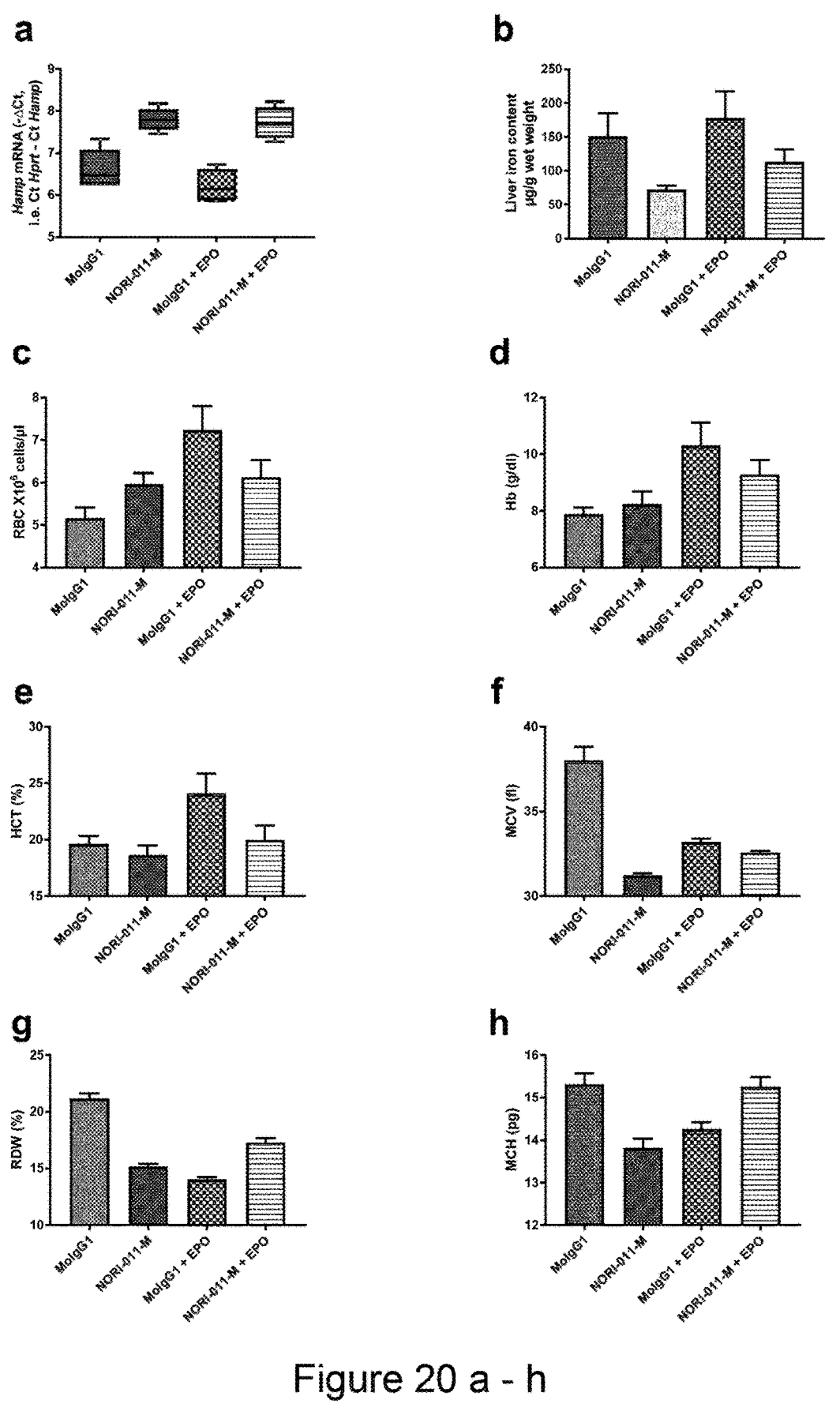

In addition, the study tried to examine the effects of the co-administration of erythropoietin (epo) which is known to improve some key parameters but with an adverse effect on iron loading and spleen size due to excessive cell death. Positive effects of this combination had been seen in experiments where epo was supplied by overexpressing recombinant fibroblasts and reduction of matriptase-2 activity by using Tmprss6 anti-sense oligonucleotide treatment in Hbbth3/+ mice (paper #164 $60^{th}$ American Society for Hematology Annual Meeting 2018). In this study, clinical grade epo (darbepoetin alpha) was co-administered with NORI-011-M once per week in one arm of the study at 30 μg/kg. As a control, epo was also co-administered with the isotype control antibody representing the effects of epo alone on the study read outs. FIG. 20 shows the results for the individual haematological parameters and the hepcidin mRNA levels in the liver samples.

Results show that again, the hepcidin levels could be consistently maintained at elevated levels over the course of the 8 weeks of the experiment (a). Accordingly, it would be expected that as seen in the examples above, this would lead to an iron restriction and a subsequent reduction in serum iron, liver iron content (b) and reduction in MCV (f). The red blood cell count and haemoglobin were not elevated substantially with NORI-011-M alone. However, maturation of red blood cells was improved in the spleen with a much larger proportion of cells at stage V (matured) than in any of the other groups (i). The increase of spleen weight was also reduced by about half with dosing of NORI-011-M alone indicating that the restriction of iron supply caused by the blockade of NORI-011-M has a normalising effect on the maturation of red blood cells (k).

The use of epo (in conjunction with an isotype control) has positive effects on red blood cell count (c) and haemoglobin (d) as expected for a stimulator of erythropoiesis. However, as previously known, this increased erythropoiesis causes an increase in cell death and the associated increase in spleens size (index) in the context of a defective beta globin synthesis (k) and the maturation into functional and high-quality red blood cells is not improved (i). As expected, epo is not able to increase hepcidin levels and therefore had no effect on liver iron levels (c).

The combination treatment of NORI-011-M and epo led to a combination of positive effects. This was expressed by a slightly reduced effect on red blood cell counts (c) and haemoglobin (d) compared to epo alone but an overall more balanced therapeutic effect including the continued reduction of liver iron overload (b) and the decrease of splenomegaly compared to epo alone (k). With an optimisation of the treatment ratio of matriptase inhibition and epo stimulation it is believed that these co-operative effects can be optimised in a clinical setting.

Example 22. 8 Week Repeat Dose Assessment of Treatment with NORI-011-M in a Mouse Model of Beta Thalassaemia with and without Co-Treatment with ActRIIB-Fc Fusion Protein In this study we demonstrate that co-treatment with NORI-11-M and an activin receptor IIB Fc fusion protein can provide beneficial therapeutic effects compared with treatment with NORI-11-M alone and ActRIIB-Fc alone. This synergy may be a reflection of different modes of action of these two agents, with the ActRIIB-Fc promoting the maturation of red blood cell precursors during erythropoiesis whilst NORI-11-M results in an iron restriction and normalisation and therefore a slowing down of the erythropoiesis leading to a more efficient generation of more matured red blood cells.

The work in this study was carried out using the methods and procedures generally as described in Example 21 above, over 8 weeks with multiple administrations for both agents. Hbbth3/+ mice (n=5/group) were injected intraperitoneally once per week with 10 mg/kg NORI-011-M antibody for 8 weeks as before. ActRIIB-Fc was injected intraperitoneally twice a week at 10 mg/kg for 8 weeks. This two-fold higher frequency with which the ActRIIb-Fc was administered, compared with the antibody, was a reflection of previously published administration protocols for similar activin receptor ligand trap molecules (Suragani R N, Cawley S M, Li R, et al. Modified activin receptor IIB ligand trap mitigates ineffective erythropoiesis and disease complications in murine β-thalassaemia. *Blood.* 2014; 123(25):3864-3872. doi:10.1182/blood-2013-06-511238 and Dussiot et al 2014 for ActRIIA-Fc).

The ActRIIB-Fc construct used in the present Example was a modified human ActRIIB extracellular domain (uniprot—Q13705, residues 26-131) with a L79D modification, fused to a mouse IgG2a-Fc domain (uniprot—P01863, residues 99-330) via a short 3× glycine linker, expressed in suspension CHO cells and purified via the Fc domain.

The treatment groups were compared against healthy untreated wild type mice ("WT") and against Hbbth3/+ mice treated with a mouse IgG1 control ("MolgG1").

FIG. 21 shows the results for the individual haematological parameters and the hepcidin mRNA levels in the liver samples. Consistent with Example 21 above, the results showed again that hepcidin levels could be consistently maintained at elevated levels over the course of the 8 weeks using NORI-11-M (FIG. 21a), demonstrating that NORI-11-M has an effect of increasing the expression levels of hepcidin, which thereby caused a decrease in liver iron levels (FIG. 21b), a decrease in serum iron, and reduced mean corpuscular volume (MCV) (FIG. 21f). For treatment with ActRIIB-Fc alone no increase in hepcidin (hamp) mRNA was observed and the co-treatment gave the same outcome as using NORI-11-M alone. Thus, despite the higher dosing frequency, ActRIIB-Fc was not able to elevate hepcidin expression directly or to reduce the liver iron levels accordingly.

Mean corpuscular haemoglobin (MCH) was reduced in mice treated with NORI-11-M, reflecting the restriction of iron supply, and was also reduced by ActRIIB-Fc (FIG. 21h), reflecting the greater number of cells being made (shown by increases in total red blood cell count and haemoglobin) and thus making less haemoglobin available per cell. Mean corpuscular volume (MCV) was also reduced (FIG. 21f). Normally a low MCV would indicate microcytic anemia but in this case the iron restriction (caused by the antibody) or the shortage of haemoglobin (caused by the enhanced maturation of more RBCs for ActRIIB-Fc) causes a reduced availability per cell, as already indicated by the MCH results.

All treatment groups improved the "quality" of generated erythrocytes, as reflected in lowering (normalisation) of red blood cell distribution width (RDW) (FIG. 21g). Uniformity of the red blood cells was thus improved. With NORI-011-M alone, red blood cell count was elevated slightly (FIG. 21$c$), but neither haemoglobin (FIG. 21$d$) nor hematocrit (FIG. 21$e$) were elevated. ActRIIB-Fc had a larger effect on all these parameters. The combination did not result in further increases over treatment with ActRIIB-Fc alone, indicating that the maturation effect on erythropoiesis is driven by ActRIIB-Fc rather than NORI-11-M. It is notable, however, that NORI-11-M did not counteract the effect of ActRIIB-Fc. Red blood cell counts were restored to wild type levels, and hematocrit and haemoglobin levels were both raised significantly, by treatment with ActRIIB-Fc alone or in combination with NORI-11-M. This is important since it indicates that the iron reduction caused by NORI-11-M is not reversing the beneficial effects on erythropoiesis produced by ActRIIB-Fc. Overall, therefore, the advantages of both treatments can still be achieved when they are used in combination, in order to both reduce iron overload and increase the production/maturation of red blood cells.

Moreover, the two agents actually lead to greater overall benefit when used together, with therapeutic potential beyond their individual uses, as seen for example by the effect on reducing splenomegaly.

The maturation of red blood cells was improved in the spleen with a much larger proportion of cells at stage V (matured) than in any of the other groups (FIG. 21$i$). The increase of spleen weight was reduced over the untreated control with both treatments indicating that even the restriction of iron supply caused by NORI-011-M has a normalising effect on the efficiency of red blood cell maturation (FIG. 21$k$).

We reported in Example 21 that the use of EPO had positive effects on red blood cell count (FIG. 20$c$) and total haemoglobin (FIG. 20$d$), as would be expected for a stimulator of erythropoiesis. However, as already known in the medical field, this increased stimulation of the erythropoiesis in the context of a continued defective beta globin synthesis also causes an increase in cell death and apoptosis and an associated further increase in spleen size and weight, so-called splenomegaly (FIG. 20$k$). Here, in the present Example, neither the use of NORI-11-M nor ActRIIB-Fc led to an increase in spleen weight over the untreated animals (FIG. 21$k$). Indeed there was actually a marked reduction in spleen weight, albeit not quite to the level of healthy animals. The combination treatment of NORI-011-M and ActRIIB-Fc appeared even superior to the monotherapies alone by reducing spleen weight even further.

Sequences

Table S below shows sequences of antigens, antibodies and other materials described in this specification. All NORI VH domains, NORI VL domains, NORI CDRs, NORI heavy chains and NORI light chains, antibodies comprising them, as well as their encoding nucleic acids, represent embodiments of the present invention.

| SEQ ID NO | Description | Sequence |
|---|---|---|
| 1 | Human matriptase-1 Uniprot ID number: Q9Y5Y6 (Cytoplasmic domain and leader sequence in italics, transmembrane domain underlined and ECD highlighted in BOLD) | *MGSDRARKGGGPKDFGAGLKYNSRHEKVNGLEEGVEFLPVNNVKKVEKHGPGRWVVL AAVLIGLLVLLGIGFLVWHLQYRDVRVQKVFNGYMRITNENFVDAYENSNTEFVSL* ASKVKDALKLLYSGVPFLGPYHKESAVTAFSEGSVIAYYWSEFSIPQHLVEEAERVMA EERVVMLPPRARSLKSFVVTSVVAFPTDSKTVQRTQDNSCSFGLHARGVELMRFTTPG FPDSPYPAHARCQWALRGDADSVLSLTFRSFDLASCDERGSDLVTVYNTLSPMEPHAL VQLCGTYPPSTNLTFHSSQNVLLITLLTNTERRHPGFEATFFQLPRMSSCGGRLRKAQ GTFNSPYYPGHYPPNIDCTWNIEVPNNQHVKVRFKFFYLLEPGVPAGTCPKDYVEING EKYCGERSQFVVTSNSNKIITVRFHSDQSYTDTGFIAEYLSYDSSDPCPGQFTCRTGRC IRKELRCDGWADCTDHSDELNCSCDAGHQFTCKNKFCKPLFWVCDSVNDCGDNSDEQG CSCPAQTFRCSNGKCLSKSQQCNGKDDCGDSGDEASCPKVNVVTCTKHTYRCLNGLCL SKGNPECDGKEDCSDGSDEKDCDCGLRSFTRQARVVGGTDADEGEWPWQVSLHALGQG HICGASLISPNWLVSAAHCYIDDRGFRYSDPTQWTAFLGLHDQSQRSAPGVQERRLKR IISHPFNDFTFDYDIALLELEKPAEYSSMVRPICLPDASHVFPAGKAIWTGWGHTQ VGGTGALILQKGEIRVINQTTCENLLPQQITPRMMCVGFLSGGVDSCQGDSGGPLSSV EADGRIFQAGVVSWGDGCAQRNKPGVYTRLPLFRDWIKENTGV |
| 2 | Human matriptase-2 Uniprot ID number: Q8IU80 (Cytoplasmic domain and leader sequence in italics, transmembrane domain underlined and ECD highlighted in BOLD) | *MLLLFHSKRMPVAEAPQVAGGQGDGGDGEEAEPEGMFKACEDSKRKARGYLRLVPLEV LLALLVLASAGVLLWYFLGVKAEVMVSQVYSGSLRVLNRHFSQDLTRRESSAFRSETA* KAQKMLKELITSTRLGTYYNSSSVYSFGEGPLTCFFWFILQIPEHRRLMLSPEVVQAL LVEELLSTVNSSAAVPYRAEYEVDPEGLVILEASVKDIAALNSTLGCYRYSYVGQGQV LRLKGPDHLASSCLWHLQGPKDLMLKLRLEWTLAECRDRLAMYDVAGPLEKRLITSVY GCSRQEPVVEVLASGAIMAVVWKKGLHSYTDPFVLSVQPVVFQACEVNLTLDNRLDSQ GVLSTPYFPSYYSPQTHCSWHLTVPSLDYGLALWFDAYALRRQKYDLPCTQGQWTIQN RRLCGLRILQPYAERIPVVATAGIINFTSQISLTGPGVRVHYGLYNQSDPCPGEFLC SVNGLCVPACDVKDCPNGLDERNCVCRATFQCKEDSTCISLPKVCDGQPDCLNGSDE EQCQEGVPCGTFTFQCEDRSCVKKFNPQCDGRPDCRDGSDEEHCDCGLQGPSSRIVGG AVSSEGEWPWQASLQVRGRHICGGALIADRWVITAAHCFQEDSMASTVLWTVFLGKVW QNSRWPGEVSRKVSRLLIHPYHEEDSHDYDVALLQLDHPVVRSAAVRPVCLPARSHFE EPGLHCWITGWGALRRGGPISNALQKVDVQLIPQDLCSEVYRYQVTPRMLCAGYRKGK KDACQGDSGGPLVCKALSGRWFLAGLVSWGLGCGRPNYFGVYTRITGVISWIQQVVT |
| 3 | Human matriptase-3 Uniprot ID number: Q7RTY8 (Cytoplasmic domain and leader sequence in italics, transmembrane domain underlined and ECD highlighted in BOLD) | *MDKENSDVSAAPADLKISNISVQVVSAQKKLPVRRPPLPGRRLPLPGRRPPQRPIGKA KPKKQSKKGVFFWNVQNKIILFTVFLFILAVIAWTLLWLYISKTRSKDAFYFAGMFRI* TNIEFLPEYRQKESREFLSVSRTVQQVINLVYTTSAFSKFYEQSVVADVSSNNKGGLL VHFWIVFVMPRAKGHIFCEDCVAALLKDSIQTSIINRTSVGSLQGLAVDMDSVVLNAG LRSDYSSTIGSDKGCSQYFYAEHLSLHYPLEISAASGRLMCHFKLVAIVGYLIRLSIK SIQIEADNVCTVDSLTIYDSLLPIRSSILYRICEPTRTLMSFVSTNNLMLVTFKSPHIR RLSGIRAYFEVIPEQKCENTVIVKDITGFEGKISSPYYPSYYPKCKCTWKFQTSLST LGIALKFYNYSITKKSMKGCEHGWWEINEHMYCGSYMDHQTIFRVPSPLVHIQLQCSS RLSDKPLLAEYGSYNISQPCPVGSFRCSSGLCVPQAQRCDGVNDCFDESDELFCVSPQ PACNTSSFRQHGPLICDGFRDCENGRDEQNCTQSIPCNNRTFKCGNDICFRKQNAKCD GTVDCPDGSDEEGCTCSRSSSALHRIIGGTFLEGGWPWQVSLHFVGSAYCGASVISR EWLLSAAHCFHGNRLSDPTPWTAHLGMYVQGNAKFVSPVRRIVVHEYYNSQTFDYDIA LLQLSIAWPETLKQLIQPICIPPTGQRVRSGEKCWVTGWGRRHEADNKGSLVLQQAEV ELIDQTLCVSTYGIITSRMLCAGIMSGKRDACKGDSGGPLSCRRKSDGKWILTGIVSW GHGSGRPNFPGVYTRVSNFVPWIHKYVPSLL |

-continued

| SEQ ID NO | Description | Sequence |
|---|---|---|
| 4 | Mouse matriptase-2 Uniprot ID number: Q9DBI0 (Cytoplasmic domain and leader sequence in italics, transmembrane domain underlined and ECD highlighted in BOLD) | *MPRCFQLPCSTRMPTTEVPQAADGQGDAGDGEEAAEPEGKFKPPKNTKRKNRDYVRFT* PLLVLAALVSAGVMLWYFLGYKAEVTVSQVYSGSLRVLNRHFSQDLGRRESIAPRSE SAKAQKMLQEIVASTRLGTYYNSSSVYSFGEGPLTCFFWFILDIPEYQRLTLSPEVVR ELLVDELLSNSSTLASYKTEYEVDPEGLVILEASVNDIVVLNSTLGCYRYSYVNPGQV LPLKGPDQQTTSCLWHLQGPEDLMIKVRLEWTRVDCRDRVAMYDAAGPLEKRLITSVY GCSRQEPVMEVLASGSVMAWWKKGWMHSYYDPFLLSVKSVAFQDCQ'VNLTLEGRLDTQ GFLRTPYYPSYYSPSTHCSWHLTVPSLDYGLALWFDAYALRRQKYNRLCTQGQWMIQN RRLCGFRTLQPYAERIPMVASDGVTINFTSQISLTGPGVQVYYSLYNQSDPCPGEFLC SVNGLCVPACDGIKDCPNGLDERNCVCRAMFQCQEDSTCISLPRVCDRQPDCLNGSDE EQCQEGVPCGTFTFQCEDRSCVKKFNPECDGQSDCRDGSDEQHCDCGLQGLSSRIVGG TVSSEGEWPWQASLQIRGRHICGGALIADRWVITAAHCFQEDSMASPKLWTVFLGKMR QNSRWPGEVSFKVSRLFLHPYHEEDSHDYDVALLQLDHPVVYSATVRPVCLPARSHFF EPGQHCWITGWGAQRGGPVSNTLQKVDVQLVPQDLCSEAYRYQVSPRMLCAGYRKGK KDACQGDSGGPLVCREPSGRWFLAGLVSWGLGCGRPNFFGYYTRVTRVINWIQQVLT |
| 5 | Rat matriptase-2 NCBI Reference Sequence: XP_006242057.1 (Cytoplasmic domain and leader sequence in italics, transmembrane domain underlined and ECD highlighted in BOLD) | *mprcfqlpcstrmptaevpqaaggggdggdgeeaaepegvfkaprnakrkdrdyvrft* plllvlaalasagvmlwyflgykaevtisqvysgslrvlnrhfsqdlarresiafrte takaqkmfqelvastrlgtyynsssiyafgegplicffwfildipeyqrltlspevvr ellvgellsnssalasyrtevevdpeglvileasvndivvlnstlgcyrysyvnpgqv irlrgpdqqtsclwhlqgpedlmlkvqlewtrvdcrdrvamydaagplekrlitsvy gcsrqepvmevlasgsvmavvwkkglhsfydpfllsvksvafqdcqvnltlegrldpq gflrtpyypsyyspsthcswhltvpsldyglalwfdayalrrqkynllctqgqwmiqn rrlcgfrtlqpyaeripvvasdgitinftsqisltgpgvqvyyslynqsdpcpgeflc svnglcvpacdgikdcpnglderncvcramfqcqedstcislprvcdrqpdclngsde eqcqegvpcgtftfqcedrscvkkpnpecdgqadcrdgsdeehcdcglqgpssrivgg amssegewpwqaslqirgrhicggaliadrwitaahcfqedsmasprlwtvflgkmr qnsrwpgevsfkvsrlflhpyheedshdyavallqldhpvvysatvrpvclparshff epgqhcwitgwgaqreggpgsstlqkvdvqlipqdlcneayryqvtprmlcagyrkgk kdacqgdsggplvckepsgrwflaglvswglgcgrpnffgyvtrvtrvvnwiqqvlt |
| 6 | Cyno matriptase-2 Uniprot ID number: A0A2K5VAP0 (Cytoplasmic domain and leader sequence in italics, transmembrane domain underlined and ECD highlighted in BOLD) | *MPVAKAPQVAGGQGQGDGGDGEEAAEPEGMFEACEDSKRKARGYLRLAPLWLTEVVLITSVG* VLLWYFLGYKAEVTVSQVYSGSLRVLNRHFSQDLTRRESSAFRSETAKAQKMLKELIA STRLGTYYNSSSVYSFGEGPLTCFFWFILQIPEHRRLMLSPEVVQALLVEELLSTVNS SAAVPYRAEYKVDPEGLVILEASVKDIAALNSTLGCYRYSYVGQGQVLRLKGPDHLAS SCLWHLQGPEDLMLKRLEWTLAECRDRLAMYDVAGPLEKRLITSVYGCSRQEPVVEV LASGATMAVVWKKGLHSYYDPFMLSVQSVVFQACEVNLTLDDRLDSQGVLSTPYFPSY YSPRTHCSWHLTVPSLDYGLALWFDAYALRRQKYDLPCTQGQWTIQNRRLCGLRILQP YAERIPVVATAGITINFTSQISLTGPGVRHYGLYNQSDPCPGEFLCSVNGLCVPACD GVKDCPNGLDERNCVCRATFQCQEDSTCISILKVCDGQPDCLNGSDEERCQEGVPCGT FTFQCEDQSCVKKPNPQCDGRPDCRDGSDEQHCDCGLQGPSSRIVGGAVSSEGEWPWQ ASLQVRGRHICGGALIADRWVITAAHCFQEDSMASPALWTVFLGKVWQNSRWPGEVSF KVSRLLHPYHEEDSHDYDVALLQLDHPVVRSAAVRPVCLPARSHFFEPGLHCWITGW GALREGGPTSNALQKVDVQLIPQDLCSEAYRYQVTPRMLCAGYRKGKKDACQGDSGGP LVCKALSGRWFLAGLVSWGLGCGRPNYFGVYTRITGVIGWIQQVVT |

-continued

| SEQ ID NO | Description | Sequence |
|---|---|---|
| 7 | Mouse HAI-2 | MAQLCELRRGRALLALVASLLLSGAQVASRELDVHESCGVSKVVGKCRASIPRWVYNI TDGSCQPFVVGGCEGNGNNYQSKEECLDKCAGVTENTTDMARNRNGADSSVLSVPRK QSAEDLSAEIFNYEEYCVPKAVTGPCRAAFPRWYDTEKNSCISFIYGGCRGNKNSYL SQEACMQHCSGKQMHFPLTPGLKAVILVGLFLMVLILLGTSMVCLIRVVRRKQERAL RTVWSTADDKEQLVKNTCVL |
| 8 | Human matriptase-2 recombinant protein | His-tagged protein | YKAEVMVSQVYSGSLRVLNRHFSQDLTRRESSAFRSETAKAQKMLKELITSTRLGTYY NSSSVVSFGEGPLTCFWFILQIPEHRRLMLSPEVVQALLVEELLSTVNSSAAVPYRA EYEVDPEGLVILEASVKDIAALNSTLGCYRYSYVGQGQVLRLKGPDHLASSCLWHLQG PKDLMLKLRLEWTLAECRDRLAMYDVAGPLEKRLITSVYGCSRQEPVVEVLASGAIMA VVWKKGLHSYTYDPFVLSVQPVVFQACEVNLTLDNRLDSQGVLSTPYFPSYYSPQTHCS WHLTVPSLDYGLALWFDAYALRRQKYDLPCTQGQWTIQNRRLCGLRILQPYAERIPVV ATAGITINFTSQISLTGPGVRVHYGLYNQSDPCPGEFLCSVNGLCVPACDGVKDCPNG LDERNCVCRATFQCKEDSTCISLPKVCDGQPDCLNGSDEEQCQEGVPCGTFTFQCEDR SCVKKPNPQCDRPCRDGSDEEHCDCGLQGPSSRIVGGAVSSEGEWPWQASLQVRGR HICGGALIADRWVITAAHCFQEDSMASTLWTVFLGKVWQNSRWPGEVSFKVSRLLLH PYHEEDSHDYDVALLQLDHPVVRSAAVRPVCLPARSHFFEPGLHCWITGWGALREGGP ISNALQKVDVQLIPQDLCSEVYRYQVTPRMLCAGYRKGKDACQGDSGGPLVCKALSG RWFLAGLVSWGLGCGRPNYFGVYTRITGVISWIQQVVTGKPIPNPLLGLDSTHHHHHH |
| 9 | Human matriptase-2 antigen eGFP/flag tag | eGFP and flag-tagged cell expressed antigen | MVSKGEELFTGVVPILVELDGDVNGHKFSVSGEGEGDATYGKLTLKFICTTGKLPVPW PTLVTTLTYGVQCFSRYPDHMKQHDFFKSAMPEGVVQERTIFFKDDGNYKTRAEVKFE GDTLVNRIELKGIDFKEDGNILGHKLEYNYNSHNVYIMADKQKNGIKVNFKIRHNIED GSVQLADHYQQNTPIGDGPVLLPDNHYLSTQSALSKDPNEKRDHMVLLEFVTAAGITL GMDELYKMLLLFHSKRMPVAEAPQVAGGQGDGDGEEAEPEGMFKACEDSKRKARGYL RLVPLFVLLALLVLASAGVLLMYFLGYKAEVMVSQVYSGSLRVLNRHFSQDLTRRESS AFRSETAKAQKMLKELITSTRLGTYYNSSSVVSFGEGPLTCFWFILQIPEHRRLMLS PEVVQALLVEELLSTVNSSAAVPYRAEYEVDPEGLVILEASVKDIAALNSTLGCYRYS YVGQGQVLRLKGPDHLASSCLWHLQGPKDLMLKLRLEWTLAECRDRLAMYDVAGPLEK RLITSVYGCSRQEPVVEVLASGAIMAVVWKKGLHSYYDPFVLSVQPVVFQACEVNLTL DNRLDSQGVLSTPYFPSYYSPQTHCSWHLTVPSLDYGLALWFDAYALRRQKYDLPCTQ GQWTIQNRRLCGLRILQPYAERIPVVATAGITINFTSQISLTGPGVRVHYGLYNQSDP CPGEFLCSVNGLCVPACDGVKDCPNGLDERNCVCRATFQCKEDSTCISLPKVCDGQPD CLNGSDEEQCQEGVPCGTFTFQCEDRSCVKKPNPQCDRPDCRDGSDEEHCDCGLQGP SSRIVGGAVSSEGEWPWQASLQVRGRHICGGALIADRWVITAAHCFQEDSMASTVLWT VFLGKVWQNSRWPGEVSFKVSRLLLHPYHEEDSHDYDVALLQLDHPVVRSAAVRPVCL PARSHFFEPGLHCWITGWGALREGGPISNALQKVDVQLIPQDLCSEVYRYQVTPRMLC AGYRKGKKDACQGDSGGPLVCKALSGRWFLAGLVSWGLGCGRPNYFGVYTRITGVISW IQQVVTDYKDDDDK |
| 10 | Human matriptase-2 antigen | Untagged cell expressed antigen | MPVAEAPQVAGGQGDGDGEEAEPEGMFKACEDSKRKARGYLRLVPLFVLLALLVLAS AGVLLMYFLGYKAEVMVSQVYSGSLRVLNRHFSQDLTRRESSAFRSETAKAQKMLKEL ITSTRLGTYYNSSSVVSFGEGPLTCFWFILQIPEHRRLMLSPEVVQALLVEELLSTV NSSAAVPYRAEYEVDPEGLVILEASVKDIAALNSTLGCYRYSYVGQGQVLRLKGPDHL ASSCLWHLQGPKDLMLKLRLEWTLAECRDRLAMYDVAGPLEKRLITSVYGCSRQEPVV EVLASGAIMAVVWKKGLHSYYDPFVLSVQPVVFQACEVNLTLDNRLDSQGVLSTPYFP SYYSPQTHCSWHLTVPSLDYGLALWFDAYALRRQKYDLPCTQGQWTIQNRRLCGLRIL QPYAERIPVVATAGITINFTSQISLTGPGVRVHYGLYNQSDPCPGEFLCSSVNGLCVPA |

-continued

| SEQ ID NO | Description | Sequence |
|---|---|---|
| | | CDGVKDCPNGLDERNCVCRATFQCKEDSTCISLPKVCDGQPDCLNGSDEQCQEGVPC |
| | | GTFTFQCEDRSCVKKPNPQCDGRPDCRDGSDEEHCDCGLQGPSSRIVGGAVSSEGEWP |
| | | WQASLQVRGRHICGGALIADRWVITAAHCFQEDSMASTVLWTVFLGKVWQNSRWPGEV |
| | | SFKVSRLLLHPYHEEDSHDYDVALLQLDHPVVRSAAVRPVCLPARSHFFEPGLHCWIT |
| | | GWGALREGGPISNALQKVDVQLIPQDLCSEVYRYQVTPRMLCAGYRKGKDACQGDSG |
| | | GPLVCKALSGRWFLAGLVSWGLGCGRPNYFGVYTRITGVISWIQQVVT |
| 11 | Human matriptase-2 K253E variant antigen | MPVAEAPQVAGGQGDGDGEEAEPEGMFKACEDSKRKARGYLRLVPLFVLLALLVLAS |
| | Untagged cell expressed antigen | AGVLIWYFLGYKAEVMVSQVYSGSLRVLNRHFSQDLTRRESSAFRSETAKAQKMLKEL |
| | | ITSTRLGTYYNSSSVVSFGEGPLTCFFWFILQIPEHRRLMLSPEVVQALLVEELLSTV |
| | | NSSAAVPYRAEYEVDPEGLVILEASVKDIAALNSTLGCYRYSYVGQGQVLRLKGPDHL |
| | | ASSCLWHLQGPEDLMLKLRLEWTLAECRDRLAMYDVAGPLEKRLITSVYGCSRQEPVV |
| | | EVLASGAIMAVVWKKGLHSYYDPFVLSVQPVFQACEVNLTLDNRLDSQGVLSTPYFP |
| | | SYYSPQTHCSWHLTVPSLDYGLALWFDAYALRRQKYDLPCTQGQWTIQNRRLCGLRIL |
| | | QPYAERIPVVATAGITINFTSQISLTGPGVRVHYGLYNQSDPCPGEFLCSVNGLCVPA |
| | | CDGVKDCPNGLDERNCVCRATFQCKEDSTCISLPKVCDGQPDCLNGSDEQCQEGVPC |
| | | GTFTFQCEDRSCVKKPNPQCDGRPDCRDGSDEEHCDCGLQGPSSRIVGGAVSSEGEWP |
| | | WQASLQVRGRHICGGALIADRWVITAAHCFQEDSMASTVLWTVFLGKVWQNSRWPGEV |
| | | SFKVSRLLLHPYHEEDSHDYDVALLQLDHPVVRSAAVRPVCLPARSHFFEPGLHCWIT |
| | | GWGALREGGPISNALQKVDVQLIPQDLCSEVYRYQVTPRMLCAGYRKGKDACQGDSG |
| | | GPLVCKALSGRWFLAGLVSWGLGCGRPNYFGVYTRITGVISWIQQVVT |
| 12 | Human matriptase-2 V736A variant antigen | MPVAEAPQVAGGQGDGDGEEAEPEGMFKACEDSKRKARGYLRLVPLFVLLALLVLAS |
| | Untagged cell expressed antigen | AGVLIWYFLGYKAEVMVSQVYSGSLRVLNRHFSQDLTRRESSAFRSETAKAQKMLKEL |
| | | ITSTRLGTYYNSSSVVSFGEGPLTCFFWFILQIPEHRRLMLSPEVVQALLVEELLSTV |
| | | NSSAAVPYRAEYEVDPEGLVILEASVKDIAALNSTLGCYRYSYVGQGQVLRLKGPDHL |
| | | ASSCLWHLQGPKDLMLKLRLEWTLAECRDRLAMYDVAGPLEKRLITSVYGCSRQEPVV |
| | | EVLASGAIMAVVWKKGLHSYYDPFVLSVQPVFQACEVNLTLDNRLDSQGVLSTPYFP |
| | | SYYSPQTHCSWHLTVPSLDYGLALWFDAYALRRQKYDLPCTQGQWTIQNRRLCGLRIL |
| | | QPYAERIPVVATAGITINFTSQISLTGPGVRVHYGLYNQSDPCPGEFLCSVNGLCVPA |
| | | CDGVKDCPNGLDERNCVCRATFQCKEDSTCISLPKVCDGQPDCLNGSDEQCQEGVPC |
| | | GTFTFQCEDRSCVKKPNPQCDGRPDCRDGSDEEHCDCGLQGPSSRIVGGAVSSEGEWP |
| | | WQASLQVRGRHICGGALIADRWVITAAHCFQEDSMASTVLWTVFLGKVWQNSRWPGEV |
| | | SFKVSRLLLHPYHEEDSHDYDVALLQLDHPVVRSAAVRPVCLPARSHFFEPGLHCWIT |
| | | GWGALREGGPISNALQKVDVQLIPQDLCSEAYRYQVTPRMLCAGYRKGKDACQGDSG |
| | | GPLVCKALSGRWFLAGLVSWGLGCGRPNYFGVYTRITGVISWIQQVVT |
| 13 | Human matriptase-2 V736A, K253E variant antigen | MPVAEAPQVAGGQGDGDGEEAEPEGMFKACEDSKRKARGYLRLVPLFVLLALLVLAS |
| | Untagged cell expressed antigen | AGVLIWYFLGYKAEVMVSQVYSGSLRVLNRHFSQDLTRRESSAFRSETAKAQKMLKEL |
| | | ITSTRLGTYYNSSSVVSFGEGPLTCFFWFILQIPEHRRLMLSPEVVQALLVEELLSTV |
| | | NSSAAVPYRAEYEVDPEGLVILEASVKDIAALNSTLGCYRYSYVGQGQVLRLKGPDHL |
| | | ASSCLWHLQGPEDLMLKLRLEWTLAECRDRLAMYDVAGPLEKRLITSVYGCSRQEPVV |
| | | EVLASGAIMAVVWKKGLHSYYDPFVLSVQPVFQACEVNLTLDNRLDSQGVLSTPYFP |
| | | SYYSPQTHCSWHLTVPSLDYGLALWFDAYALRRQKYDLPCTQGQWTIQNRRLCGLRIL |
| | | QPYAERIPVVATAGITINFTSQISLTGPGVRVHYGLYNQSDPCPGEFLCSVNGLCVPA |
| | | CDGVKDCPNGLDERNCVCRATFQCKEDSTCISLPKVCDGQPDCLNGSDEQCQEGVPC |
| | | GTFTFQCEDRSCVKKPNPQCDGRPDCRDGSDEEHCDCGLQGPSSRIVGGAVSSEGEWP |
| | | WQASLQVRGRHICGGALIADRWVITAAHCFQEDSMASTVLWTVFLGKVWQNSRWPGEV |

-continued

| SEQ ID NO | Description | Sequence |
|---|---|---|
| | | SFKVSRLLLHPYHEEDSHDYDVALLQLDHPVVRSAAVRPVCLPARSHFFEPGLHCWIT GWGALREGGPISNALQKVDVQLIPQDLCSEAYRYQVTPRMLCAGYRKGKKDACQGDSG GPLVCKALSGRWFLAGLVSWGLGCGRPNYFGVYTRITGVISMIQQVVT |
| 14 | Human matriptase-1 antigen his tag | MGSDRARKGGGGPKDFGAGLKYNSRHEKVNGLEEGVEFLPVNNVKKVEKHGPGRWVVL AAVLIGLLLVLLGIGFLVWHLQYRDVRVQKVFNGYMRITNENFVDAYENSNSTEFVSL ASKVKDALKLLYSGVPFLGPYHKESAVTAFSEGSVIAYYWSEFSIPQHLVEEAERVMA EERVVMLPPRARSLKSFVVTSVVAPPTDSKTVQRTQDNSCCSFGLHARGVELMRFTTPG FPDSPYPAHARCQWALRGDADSVLSLTFRSPDLASCDERGSDLVTVYNTLSPMEPHAL VQLCGTYPPSYNLTFHSSQNVLLITLITNTERRHPGFEATFFQLPRMSSCCGRLRKAQ GTFNSPYYPGHYPPNIDCTWNIEVPNNQHVKVRFKFFYLLEPGVPAGTCPKDYVEING EKYCGERSQFVVTSNSNKITVRFHSDQSYTDTGFLAEYLSYDSSDPCPGQPTCRTGRC IRKELRCDGWADCTDHSDELNCSCDAGHQFTCKNKFCPKLFWCDSVNDCGDNSDEQG CSCPAQTFRCSNGKCLSKSQQCNGKDDCGDGSDEASCPKVNVTCTKHTYRCLNGLCL SKGNPECDGKEDCSDGSDEKDCDCGLRSFTRQARVVGGTDADEGEWPWQVSLHALGQG HICGASLISPNWLVSAAHCYIDDRGFRYSDPTQWTAFLGLHDQSQRSAPGVQERRLKR IISHPFNDFTFDYDIALLELEKPAEYSSNVRPICLPDASHVFPAGKAIWTGWGHTQ YGGTGALILQKGEIRVINQTTCENLLPQQITPRMMCVGFLSGGVDSCQGDSGGPLSSV EADGRIFQAGVVSWGDGCAQRNKPGVYTRLPLFRDWIKENTGVGGGSHHHHHH |
| 15 | Human matriptase-3 antigen his tag | MDKENSDVSAAPADLKISNISVQVVSAQKKLPVRRPPLPGRRLPLPGRRPPQRPIGKA KPKKQSKKKVPFWNVQNKIILFTVFLFILAVIAWTLLMLYISKTESKDAFYFAGMFRI TNIEFLPEYRQKESREFLSVSRTVQQVINLVYTTSAFSKFYEQSVVADVSSNNKGGLL VHFWIVFVMPRAKGHIFCEDCVAAILKDSIQTSIINRTSVGSLQGLAVDMDSVVLNAG LRSDYSSTIGSDKGCSQYFYAEHLSLHYPLEISAASGRLMCHFKLVAIVGYLIRLSIK SIQIEADNCVTDSLTIYDSLLPIRSSILYRICEPTRTLMSFVSTNNLMLVTFKSPHIR RLSGIRAYFEVIPEQKCENTVLVKDITGFEGKISSPYYPSYYPPCKCTWKFQTSLST LGIALKFYNYSITKKSMKGCBHGWWEINEHMYCGSYMDHQTIFRVPSPLVHIQLQCSS RLSDKPLLAEYGSYNISQPCPVGSFRCCSSGLCVPQAQRCDGVNDCFDESDELFCVSPQ PACNTSSFRQHGPLICDGFRDCENGRDEQNCTQSIPCNNRTFKCGNDICFRKQNAKCD GTVDCPDGSDEEGCTCSRSSSALHRIIGGTDTLEEGWPWQVSLHFVGSAYCGASVISR EWLLSAAHCFHGNRLSDPTPWTAHLGMYVQGNAKFVSPVRRIVVHEYYNSQTFDYDIA LLQLSIAWPETLKQLIQPICIPPTGQRVRSGEKCWVTGWGRRHEADNKGSLVLQQAEV ELIDQTLCVSTYGIITSRMLCAGIMSGKRDACKGDSGGPLSCRRKSDGKWILTGIVSW GHGSGRPNFPGVYTRVSNFVPWIHKYVPSLLGGGGSHHHHHH |
| 16 | Mouse matriptase-2 antigen eGFP/flag tag | MVSKGEELFTGVPILVELDGDVNGHKFSVSGEGEGDATYGKLTLKFICTTGKLPVPW PTLVTTLTYGVQCFSRYPDHMKQHDFFKSAMPEGYVQERTIFFKDDGNYKTRAEVKFE GDTLVNRIELKGIDFKEDGNILGHKLEYNYNSHNVVIMADKQKNGIKVNFKIRHNIED GSVQLADHYQQNTPIGDGPVLLPDNHYLSTQSALSKDPNEKRDHMVLLEFVTAAGITL GMDELYKMPRCFQLPCSTRMPTTEVPQAADGQGDAGDGEEAAEPEGKFKPPKNTKRKN RDYVRFTPLLLVLAALVSAGVMLWYFLGYKAEVTVSQVYSGSLRVLNRHFSQDLGRRE SIAFRSESAKAQKMLQELVASTRLGTYYNSSSVYSFGEGPLTCFFWFILDIPEYQRLT LSPEVVRELLVDELLSNSSTLASYKTEYEVDPEGLVILEASVNDIVVLNSTLGCYRYS YVNPGQVLPLKGPDQQTTSCLWHLQGPEDLMIKVRLEWTRVDCRDRVAMYDAAGPLEK RLITSVYGCSRQEPVMEVLASGSVNAVVWKKGMHSYYDPFLLSVKSVAFQDCQVNLTL EGRLDTQGFLRRTPIYPSPYSPSTHCSWHLTVPSLDYGLALWFDAYALRRQKYNRLCTQ GQWMIQNRRLCGFRTLQPYAERIPMVASDGVTINFTSQISLTGPGVQVYYSLYNQSDP CPGEFLCSVNGLCVPACDGIKDCPNGLDERNCVCRAMFQCQEDSTCISLPRVCDRQPD CLNGSDEEQCQEGVPCGTFTFQCEDRSCVKKPNPECDGQSDCRDGSDEQHCDCGLQGL |

-continued

| SEQ ID NO | Description | Sequence |
|---|---|---|
| | | SSRIVGGTVSSEGEWPWQASLQIRGRHICGGALIADRWVITAAHCFQEDSMASPKLWT<br>VFLGKMRQNSRWPGEVSFKVSRLFLHPYHEEDSHDYDVALLQLDHPVVYSATVRPVCL<br>PARSHFFEPGQHCWITGWGAQREGGPVSNTLQKVDVQLVPQDLCSEAYRYQVSPRMLC<br>AGYRKGKKDACQGDSGGPLVCREPSGRWFLAGLVSWGLGCCRPNFFGVYTRVTRVINW<br>IQQVLTDYKDDDDK |
| 17 | Mouse matriptase-2 antigen<br>Untagged cell expressed antigen | MPTTEVPQAADGQGDAGDGEEAAEPEGKFKPPKNTKRKNRDYVRFTPLLLVLAALVSA<br>GVMLWYFLGYKAEVTVSQVYSGSLRVLNRHFSQDLGRRESIAFRSESAKAQKMLQELV<br>ASTRLGTYYNSSVSYFGEGPLTCFWFILDIPEYQRLTLSPEVVRELLVDELLSNSS<br>TLASYKTEYEVDPEGLVILEASVNDIVVLNSTLGCYRYSYVNPGQVLPLKGPDQQTTS<br>CLWHLQGPEDLMIKVRLEWTRVDCRDRVAMYDAAGPLEKRLITSVYGCSQEPVMEVL<br>ASGSVMAVVWKKGMHSYDPFLLSVKSVAFQDCQVNLTLEGRLDTQGFLRTPYYPSYY<br>SPSTHCSWHLTVPSLDYGLALWFDAYALRRQKYNRLCTQGQMIQNRRLCGFRTLQPY<br>AERIPMVASDGVTINFTSQISLTGPGVQVYYSLYNQSDPCPGEFLCSVNGLCVPACDG<br>IKDCPNGLDERNCVCRAMFQCQEDSTCISLPRVCRQPDCLNGSDEEQCQEGVPCGTF<br>TFQCEDRSCVKKPNPECDGQSDCRDGSDEQHCDCGLQGLSSRIVGGTVSSEGEWPWQA<br>SLQIRGRHICGGALIADRWVITAAHCFQEDSMASPKLWTVFLGKMRQNSRWPGEVSFK<br>VSRLFLHPYHEEDSHDYDVALLQLDHPVVYSATVRPVCLPARSHFFEPGQHCWITGWG<br>AQREGGPVSNTLQKVDVQLVPQDLCSEAYRYQVSPRMLCAGYRKGKKDACQGDSGGPL<br>VCREPSGRWFLAGLVSWGLGCGRPNFFGVYTRVINWIQQVLT |
| 7 | Mouse HAI-2 antigen<br>Untagged cell expressed antigen | MAQLCELRRGRALLALIVASLLLSGAQVASRELDVHESCGVSKVVGKCRASIPRWWVNI<br>TDGSCQPFVYGGCEGNGNNYQSKERCLDKCAGVTENTTDDMARNRNGADSSVLSVPRK<br>QSAEDLSAEIFNYEEYCVPKAVTGPCRAAFPRWYDTEKNSCISFIYGGCRGNKNSYL<br>SQEACMQHCSGKQMHPFLTPGLKAVILVGLFLMVLILLLGTSMVCLIRVVRRKQERAL<br>RTVWSTADDKEQLVKNTCVL |
| 18 | Rat matriptase-2 antigen<br>Untagged cell expressed antigen | MPTAEVPQAAGGQGDGDGEEAAEPEGVFKAPRNAKRKDRDYVRFTPLLLVLAALASA<br>GVMLWYFLGYKAEVTISQVYSGSLRVLNRHFSQDLARRESIAFRTETAKAQKMFQELV<br>ASTRLGTYYNSSSIYAFGEGPLICFWFILDIPEYQRLTLSPEVVRELLVGELLSNSS<br>ALASYRTEYEVDPEGLVILEASVNDIVVLNSTLGCYRYSYVNPGQVLRLRGPDQQTTS<br>CLWHLQGPEDLMLKVQLEWTRVDCRDRVAMYDAAGPLEKRLITSVYGCSQEPVMEVL<br>ASGSVMAVVWKKGLHSFYDPFLLSVKSVAFQDCQVNLTLEGRLDPQGFLRTPYYPSYY<br>SPSTHCSWHLTVPSLDYGLALWFDAYALRRQKYNLLCTQGQMIQNRRLCGFRTLQPY<br>AERIPVVASDGITINFTSQISLTGPGVQVYYSLYNQSDPCPGEFLCSVNGLCVPACDG<br>IKDCPNGLDERNCVCRAMFQCQEDSTCISLPRVCRQPDCLNGSDEEQCQEGVPCGTF<br>TFQCEDRSCVKKPNPECDGQADCRDGSDEHCDCGLQGPSSRIVGGAMSSEGEWPWQA<br>SLQIRGRHICGGALIADRWVITAAHCFQEDSMASPRLWTVFLGKMRQNSRWPGEVSFK<br>VSRLFLHPYHEEDSHDYDVALLQLDHPVVYSATVRPVCLPARSHFFEPGQHCWITGWG<br>AQREGGPGSSTLQKVDVQLIPQDLCNEAYRYQVTPRMLCAGYRKGKKDACQGDSGGPL<br>VCKEPSGRWFLAGLVSWGLGCGRPNFFGVYTRVRVNWIQQVLT |
| 19 | Cyno matriptase-2 antigen<br>Untagged cell expressed antigen | MPVAKAPQVAGGQGDGDGEEAAEPEGMFEACEDSKRKARGYIRLAPLWLTILVVLITSVG<br>VLLWYFLGYKAEVTVSQVYSGSLRVLNRHFSQDLTRRESSAFRSETAKAQKMLKELIA<br>STRLGTYYNSSVVSYSPGEGPLTCFWFILQIPEHRRLMLSPEVVQALLVEELLSTVNS<br>SAAVPYRAEYEVDPEGLVILEASVKDIAALNSTLGCYRYSYVGQGGVLRLKGPDHLAS<br>SCLWHLQGPEDLMLKLRLEWTLAECRDRLAMYDVAGPLEKRLITSVYGCSRQEPVVEV<br>LASGAIMAVVWKKGLHSYDPFMLSVQSVVFQACEVNLTLDDRLDSQGVLSTPYFPSY<br>YSPRTHCSWHLTVPSLDYGLALWFDAYALRRQKYDLPCTQGQWTIQNRRLCGLRILQP<br>YAERIPVVATAGITINFTSQISLTGPGVRVHYGLINQSDPCPGEFLCSVNGLCVPACD |

-continued

| SEQ ID NO | Description | Sequence |
|---|---|---|
| | | GVKDCPNGLDERNCVCRATFQCQEDSTCISLLKVCDGQPDCLNGSDEERCQEGVPCGT FTFQCEDQSCVKKPNPQCDGRPDCRDGSDEQHCDCGLQPSSRIVGGAVSSEGEWPWQ ASLQVRGRHICGGALIADRWVITAAHCFQEDSMASPALWTVFLGKVWQNSRMPGEVSF KVSRLLLHPYHEEDSHDYDVALLQLDHPVVRSAAVRPVCLPARSHFFEPGLHCWITGW GALREGGPTSNALQKDVQLIPQDLCSEAYRYQVTPRMLCAGYRKGKKDACQGDSGGP LVCKALSGRWFLAGLVSWGLGCGRPNYFGVYTRITGVIGWIQQVVT |
| 20 | Human matriptase-2 ECD protein his tag | YKAEVWVSQVYSGSLRVLNRHFSQDLTRRESSAFRSETAKAQKMLKELITSRLGTYY NSSSSVYSFGEGPLTCFWFIIQIPEHRRLMLSPEVVQALLVEELLSTVNSSAAVPYRA EYEVDPEGLVILEASVKDIAALNSTLGCYRYSYVGQGQVLRLKGPDHLASSCLWHLQG PKDLMLKLRLEWTLAECRDRLAMYDVAGPLEKRLITSVYGCSRQEPVVEVLASGAIMA VVWKKGLHSYYDPFVLSVQPVVFQACEVNLTLDNRLDSQGVLSTPYFPSYYSPQTHCS WHLTVPSLDYGLALWFDAYALRRQKYDLPCTQGQWTIQNRRLCGLRILQPYAERIPVV ATAGITINFTSQISLTGPGVRVHYGLYNQSDPCPGEFLCSVNGLCVPACDGVKDCPNG LDERNCVCRATFQCKEDSTCISLPKVCDGQPDCLNGSDEEQCQEGVPCGTFTFQCEDR SCVKKPNPQCDGRPDCRDGSDEEHCDCGLQPSSRIVGGAVSSEGEWPWQASLQVRGR HICGGALIADRWVITAAHCFQEDSMASTVLWTVFLGKVWQNSRWPGEVSFKVSRLLLH PYHEEDSHDYDVALLQLDHPVVRSAAVRPVCLPARSHFFEPGLHCWITGWGALREGGP ISNALQKVDVQLIPQDLCSEVYRYQVTPRMLCAGYRKGKKDACQGDSGGPLVCKALSG RWFLAGLVSWGLGCGRPNYFGVYTRITGVISWIQQVVTGGGGSGGGGSHHHHHGSHH HH |
| 21 | Human matriptase-2 mask ECD protein his tag | YKAEVWVSQVYSGSLRVLNRHFSQDLTRRESSAFRSETAKAQKMLKELITSRLGTYY NSSSSVYSFGEGPLTCFWFIIQIPEHRRLMLSPEVVQALLVEELLSTVNSSAAVPYRA EYEVDPEGLVILEASVKDIAALNSTLGCYRYSYVGQGQVLRLKGPDHLASSCLWHLQG PKDLMLKLRLEWTLAECRDRLAMYDVAGPLEKRLITSVYGCSRQEPVVEVLASGAIMA VVWKKGLHSYYDPFVLSVQPVVFQACEVNLTLDNRLDSQGVLSTPYFPSYYSPQTHCS WHLTVPSLDYGLALWFDAYALRRQKYDLPCTQGQWTIQNRRLCGLRILQPYAERIPVV ATAGITINFTSQISLTGPGVRVHYGLYNQSDPCPGEFLCSVNGLCVPACDGVKDCPNG LDERNCVCRATFQCKEDSTCISLPKVCDGQPDCLNGSDEEQCQEGVPCGTFTFQCEDR SCVKKPNPQCDGRPDCRDGSDEEHCDCGLQPSSRGGGGSGGGGSHHHHHGSHHHH |
| 22 | Human matriptase-1 ECD protein his tag | WHLQYRDVRVQKVFNGYMRITNENFVDAYENSNSTEFVSLASKVKDALKLLYSGVPFL GPYHKSAVTAFSEGSVIAYYWSEFSIPQHLVEEAERVMAERVVMLPPRARSLKSFV VTSVVAPPTDSKTVQRTQDNSCSFGLHARGVELMRFTTPGFPDSPYPAHARCQWALRG DADSVLSLTFRSFDLASCDERGSDLVTVNTLSPMEPHALVQLCGTYPPSYNLTFHSS QNVLILTLIINTERRHPGFEATFFQLPRMSSCCGRLRKAQGTFNSPYYPGHYPPNIDC TWNIEVPNNQHVKVRFKFFYLLEPGVPAGTCPKDYVEINGKYCGERSQFVTSNSNK ITVRFHSDQSYTDTGFLAEYLSYDSSDPCPGQFTCRTGRCIRKELRCDGWADCTDHSD ELNCSCDAGHQFTCKNKFCKPLFWCDSVNDCGDNSDEQGSCPAQTFRCSNGKCLSK SQQCNGKDDCGDGSDEASCPKVNVTCTKHTYRCLNGLCLSKGNPECDGKEDCSDGSD EKDCDCGLRSFTRQARVGGTDADEGEWPWQVSLHALGQGHICGASLISPNWLVSAAH CYIDDRGFRYSDPTQWTAFLGLHDQSQRSAPGVQERRLKRIISHPFNDTFDYDIAL LELEKPAEYSSMVRPICLPDASHVFPAGKAIWTGWHTOYGGTGALILOKGEIRVIN QTTCENLLPQQITPRMMCVGFLSGGVDSCCQGDSGGPLSSVEADGRIFQAGVSWGDGC AQRNKPGVYTRLPLFRDWIKENTGVGGGSGGGGSHHHHHH |
| 23 | Mouse matriptase-2 ECD | YKAEVTVSQVYSGSLRVLNRHFSQDLGRRESIAFRSESAKAQKMLQELVASTRLGTYY NSSSSVYSFGEGPLTCFWFILDIPEYQRLITLSPEVVRELLVDELLLSNSSTLASYKTEY EVDPEGLVILEASVNDIVVLNSTLGCYRYSYVNPGQVLPLKGPDQQTTSCLWHLQGPE |

-continued

| SEQ ID NO | Description | Sequence |
|---|---|---|
| | protein his tag | DLMIKVRLEWTRVDCRDRVAMYDAAGPLEKRLITSVYGCSRQEPVMEVLASGSVMAVV WKKGMHSYDPFLLSVKSVAFQDCQVNLTLEGRLDTQGFLRTPYYSPSTHCSWH LTVPSLDYGLALWFDAYALRRQKYNRLCTQGQWMIQNRRLCGFRTLQPYAERIPMVAS DGVTINFTSQISLTGPGVQVYYSLYNQSDPCPGEFLCSVNGLCVPACDGIKDCPNGLD ERNCVCRAMFQCQEDSTCISLPRVCDRQPDCLNGSDEEQCQEGVPCGTFTPQCEDRSC VKKPNPECDGQSDCRDGSDEQHCDCGLQGLSSRIVGGTVSSEGEWPWQASLQIRGRHI CGGALIADRWVITAAHCFQEDSMASPKLWTVFLGKMRQNSRMPGEVSFKVSRLFLHPY HEEDSHDYDVALLQLDHPVVYSATVRPVCLPARSHFFEPGQHCWITGWGAQREGGPVS NTLQKVDVQLVPQDLCSEAYRQVSPRMLCAGYRKGKKDACQGDSGGPLVCREPSGRW FLAGLVSWGLGCGRPNFFGVYTRVTRVINWIQQVLTGGGSGGGGSHHHHHGSHHHH |
| 24 | Mouse HAI-2 ECD protein His-tagged protein | ASRELDVHESCGVSKVVGKCRASIPRWVNITDGSCQPFVVGGCEGNGNNYQSKEECL DKCAGVTENTTDDMARNRNGADSSVLSVPRKQSAEDLSAEIFNYEEYCVPKAVTGPCR AAFPRWYDTEKNSCISFIYGGCRGNKNSYLSQEACMQHCSGKQMHPFLTPGLK |
| 25 | Cyno matriptase-2 ECD protein His tag His-tagged protein | VSQVYSGSLRVLNRHFSQDLTRRESSAFRSETAKAQKMLKELIASTRLGTYYNSSSVY SFGEGPLTCFWFILQIPEHRRLMLSPEVVQALLVBELLSTVNSSAAVPYRAEYEVDP EGLVILEASVKDIAALNSTLGCYRYSYVGQQVLRLKGPDHLASSCLWHLQGPEDLML KLRLEWTLAECRDRLAMYDVAGPLEKRLITSVYGCSRQEPVVEVLASGAIMAVVWKKG LHSYYDPFMLSVQSVVFQACEVNLITLDDRLDSQGVLSTPYFPSYYSPRTHCSWHLTVP SLDYGLALWFDAYALRRQKYDLPCTQGQWTIQNRRLCGLRILQPYAERIPVVATAGIT INFTSQISLTGPGVRVHYGLYNQSDPCPGEFLCSVNGLCVPACDGVKDCPNGLDERNC VCRATFQCQEDSTCISLLKVCDGQPDCLNGSDEERCQEGVPCGTFTFQCEDQSCVKKP NPQCDGRPDCRDGSDQHCDCGLQGPSSRIVGGAVSSEGEWPWQASLQVRGRHICGGA LIADRWVITAAHCFQEDSMASPALWTVFLGKVWQNSRWPGEVSFKVSRLLLHPYHEED SHDYDVALLQLDHPVVRSAAVRPVQVTPRMLCAGYRKGKKDACQGDSGGPLVCKALSGRWFLAG KVDVQLIPQDLCSEAYRQVTPRMLCAGYRKGKKDACQGDSGGPLVCKALSGRWFLAG LVSWGLGCGRPNYFGVYTRITGVIGNWIQQVVTGGGSGGGGSHHHHHGSHHHH |
| 26 | Rat matriptase-2 ECD protein his tag His-tagged protein | YKAEVTISQVYSGSLRVLNRHFSQDLARRESIAFRTETAKAQKMFQELVASTRLGTYY NSSSIYAFGEGPLICFFWFILDIPEYQRLTLSPEVVRELLVGELLSNSSALASYRTEY EVDPEGLVILEASVNDIVVLNSTLGCYRYSVVNPGQVLRLRGPDQQTTSCLWHLQGPE DLMLKVQLEWTRVDCRDRVAMYDAAGPLEKRLITSVYGCSRQEPVMEVLASGSVMAVV WKKGLHSFYDPFLLSVKSVAFQDCQVNLTLEGRLDPQGFLRTPYYSPSTHCSWH LTVPSLDYGLALWFDAYALRRQKYNLLCTQGQWMIQNRRLCGFRTLQPYAERIPVVAS DGITINFTSQISLTGPGVQVYYSLYNQSDPCPGEFLCSVNGLCVPACDGIKDCPNGLD ERNCVCRAMFQCQEDSTCISLPRVCDRQPDCLNGSDEEQCQEGVPCGTFTPQCEDRSC VKKPNPECDGQADCRDGSDEHCDCGLQGPSSRIVGGAMSSEGEWPWQASLQIRGRHI CGGALIADRWVITAAHCFQEDSMASPRLWTVFLGKMRQNSRWPGEVSFKVSRLFLHPY HEEDSHDYDVALLQLDHPVVYSATVRPVCLPARSHFFEPGQHCWITGWGAQREGGPGS STLQKVDVQLIPQDLCNEAYRQVTPRMLCAGYRKGKKDACQGDSGGPLVCKEPSGRW FLAGLVSWGLGCGRPNFFGVYTRVTRVNWIQQVLTGGGSGGGGSHHHHHGSHHHH |
| 27 | Flag tag | DYKDDDDK |

-continued

| SEQ ID NO | | Description | Sequence |
|---|---|---|---|
| 28 | Aprotinin | Uniprot ID number: P00974 (signal peptide sequence in italics, propeptide underlined and mature chain highlighted in BOLD) Sigma Catalog Number: A3428 | *MKMSRLCLSVALLVLLGTLAASTPGCDTSNQAKA*QRPDFCLEPPYTGPCKARIIRYFYNAKAGLCQTFVYGGCRAKRNNFKSAEDCMRTCGGAIGPWENL |
| 29 | NORI-001 | CDRH1 (IMGT) | GYTLSEFS |
| 30 | NORI-001 | CDRH2 (IMGT) | FDPEKGKT |
| 31 | NORI-001 | CDRH3 (IMGT) | VTEGHFYGSGVFDF |
| 32 | NORI-001 | CDRH1 (KABAT) | EFSIH |
| 33 | NORI-001 | CDRH2 (KABAT) | GFDPERGRTIYAQRFQG |
| 34 | NORI-001 | CDRH3 (KABAT) | EGHFYGSGVFDF |
| 35 | NORI-001 | Heavy chain variable region | QVQLVQSGAEVRRPGASVRVSCRVSGYTLSEFSIHWVRQAPGRGLEWMGGFDPERGRT IYAQRFQGRVTMTEDTSTDTAYMDLSLRSEDTAVYYCVTEGHFYGSGVFDFWGQGTL VTVSS |
| 36 | NORI-001 | Nucleic acid sequence of VH | CAGGTCCAGCTGGTACAATCTGGGGCTGAGGTGAGGAGACCTGGGGCCTCAGTGAGG TCTCCTGCAAAGTCTCCGGATACACCCTCAGTGAATTCTCATACACTGGGTGCGACA GGCTCCTGGAAAAGGGCTTGAGTGAGTGGATGGGAGGCTTTGATCCTGAAAAAGGTAAAACA ATCTACGCACAGAAGTTCCAGGGCAGAGTCACCATGACCGAGGACACCATCAACAGACA CAGCCTACATGGACCTGAGCAGCCTGAGATCTGAGGACACGGCCGTGTATTACTGT GT AACAGAGGGACATTTCTATGGTTCGGGGGTCTTTGACTTCTGGGGCCAGGGAACCCTG GTCACCGTCTCCTCA |
| 37 | NORI-001 | Full heavy chain sequence | QVQLVQSGAEVRRPGASVRVSCRVSGYTLSEFSIHWVRQAPGRGLEWMGGFDPERGRT IYAQRFQGRVTMTEDTSTDTAYMDLSLRSEDTAVYYCVTEGHFYGSGVFDFWGQGTL VTVSSASTRGPSVFPLAPCSRSTSESTAALGCLVRDYFPEPVTVSWNSGALTSGVHTF PAVLQSSGLYSLSSVVTVPSSSLGTKIYTCNVDHKPSNTKVDKRVESKYGPPCPPCPA PEFEGGPSVFLFPPKPKDTLMISRTPEVTCVVVDVSQEDPEVQFNWYVDGVEVHNAKT RPREEQFNSTYRVVSVLTVLHQDWLNGREYRCRVSNRGLPSSIERTISRARGQPREPQ VYTLPPSQEEMTRNQVSLTCLVRGFYPSDIAVEWESNGQPENNYRTTPPVLDSDGSFF LYSRLTVDRSRWQEGNVFSCSVMHEALHNHYTQRSLSLSLGR |

-continued

| SEQ ID NO | | Description | Sequence |
|---|---|---|---|
| 38 | NORI-001 | Full heavy chain sequence | CAGGTCCAGCTGGTACAATCTGGGCTGAGGTGAAGAAGCCTGGGGCCTCAGTGAAGG<br>TCTCCTGCAAAGTCTCCGGATACACCCTCAGTGAATTCTCCATACACTGGGTGCGACA<br>GGCTCCTGGAAAAGGGCTTGAGTGGATGGGAGGCTTTGATCCTGAAAAAGTAAAACA<br>ATCTACGCACCAACATGACCTGAGCAGCCTGAGCTCACCGAGGACACATCAACAGACA<br>CAGCCTACACTGACCTGAGCGCTTCGGGGGTCTTTGACTTCTGGGGCCAGGGAACCCTG<br>AACAGAGGGACATTCTATGTTCGGGGGTCTTTGACTTCTGGGGCCAGGGAACCCTG<br>GTCACCGTCTCCTCAGCACCAAGGGCCCTTCCGTGTTCCCCCTGGCCCCCTGCA<br>GCAGGAGCACCTGCGAATCCACAGCTGCCTGGGCTGTCTGGTGAAGGACTACTTTCC<br>CGAGCCCGTGACCGTGAGCTGGAACAGCGGCGCTCGACATCCGGCGTCCACACCTTT<br>CCTGCCGTCCTGCAGTCCTCCGGCCTCTACTCCCTGTCTCCGTGGTGACCGTGCCTA<br>GCTCCTCCCTGCCAGACCTACACCTGAACGTGGACCACAAACCCTCCAACAC<br>CAAGGTGGACAAACGGGTGGAGGCAAGTACGGCCCTCCCTGCCTCCTTGTCCTTGCC<br>CCCGAGTTCGAAGGCGGACACCCCAGCGTGTTCCTCTTCCTCCTAAGCCCAAGGACACCC<br>TCATGATCAGCCGGACACCCCAGGTGACTTCAACTGCCAGGTGGCTGGAGGTGCACAACGCCAAGACA<br>CCCTGAGGTCTCAGTTCAACTGGTATGTGGACGGCGTGGAGGTGCACAACGCCAAGACA<br>AAGCCCCGGGAAGAGCAGTTCAACTCCACCTACAGGGTGGTCAGCGTGCTCACCGTGC<br>TGCATCAGGACTGGCTGAACGGCAAGGAGTACAAGTGCAAGGTCAGCAATAAGGGACT<br>GCCCAGCAGCATCGAGAAGACCATCTCCAAGGCTAAAGGCCAGCCCCGGGAACCTCAG<br>GTGTACACCCTGCCTCCCAGCAGGGAGGATGACCAAGAACCAGTGAGCCTGACCT<br>GCCCGGAGAACATTATAGACACCACCCCTCCCGTGCTGGACTCGTCTCGACAGCGATGGGAGTCCAACGGCCA<br>GCCCGAGAACAATTATAGACACCACCCCTCCCGTGCTGGATAAAGTCCAGGTGCAGAAGAGCAACGTGTTCAGCT<br>CTGTACTCCAGCTGACCGTGGATAAAGTCCAGGTGCAGAAGAGCAACGTGTTCAGCT<br>GCTCCGTGATGCACGAGGCCCTGCACAATCACTACACCCAGAAGTCCCTGAGCCTGTC<br>CCTGGGAAAG |
| 39 | NORI-001 | CDRL1 (IMGT) | QGLRFD |
| 40 | NORI-001 | CDRL2 (IMGT) | AAS |
| 41 | NORI-001 | CDRL3 (IMGT) | LQHNNYPWT |
| 42 | NORI-001 | CDRL1 (KABAT) | RPSQGLRFDFG |
| 43 | NORI-001 | CDRL2 (KABAT) | AASILQS |
| 41 | NORI-001 | CDRL3 (KABAT) | LQHNNYPWT |
| 44 | NORI-001 | Light chain variable region | DIQMTQSPSSLSASVGDRVIITCRPSQGLRFDFGWYQQRPGKAPRLIYAASILQSGV<br>PSRFSGSGSGTEFTLTISSLQPEDFATYYCLQHNNYPWTFGQGTKVEIK |
| 45 | NORI-001 | Nucleic acid sequence of VL | GACATCCAGATGACCCAGTCTCCATCATCCCTGTCTGCATCTGTTGGAGACAGAGTCA<br>CCATCACTTGCCGGCCAAGTCAGGGCCTTAGGTTTGATTTCGGCTGGTATCAACAGAG<br>ACCAGGTAAAGCCCCTAGGCCCTGATCTATGCGGCATCCATTTTGCAAAGTGGGGTC |

-continued

| SEQ ID NO | | Description | Sequence |
|---|---|---|---|
| 46 | NORI-001 | Full light chain sequence | CCATCAAGATTCAGCGGCAGTGGATCTGGGACAGAGAATTCACTCTCACAATCAGCAGCC TGCAGCCTGAAGATTTTGCAACTTATTACTGTCTACAACATAACAATTATCCGTGGAC GTTCGGCCAAGGGACCAAGGTGGAAATCAAA |
| 46 | NORI-001 | Amino acid sequence light chain | DIQMTQSPSSLSASVGDRVTITCRPSQGLRFDFGWYQQRPGKAPRRLIYAASILQSGV PSRFSGSGSGTEFTLTISSLQPEDFATYYCLQHNNYPWTFGQGTKVEIKRTVAAPSVF IFPPSDEQLKSGTASVVCLLNNFYPREAKVQMKVDNALQSGNSQESVTEQDSKDSTYS LSSTLTLSKADYEKHKVYACEVTHQGLSSPVTKSFNRGEC |
| 47 | NORI-001 | Nucleic acid sequence light chain | GACATCCAGATGACCCAGTCTCCATCATCCCTGTCTGCATCTGTTGGAGACAGAGTCA CCATCACTTGCCGGCCAAGTCAGGGCCTTAGATTTGATTTCGGCTGGTATCAACAGAG ACCAGGTAAAGCCCCTAGGCGCCCTGATCTATGCGGCATCCATTTTGCAAAGTGGGGTC CCATCAAGATTCAGCGGCAGTGGATCTGGGACAGAATTCACTCTCACAATCAGCAGCC TGCAGCCTGAAGATTTTGCAACTTATTACTGTCTACAACATAACAATTATCCGTGGAC GTTCGGCCAAGGGACCAAGGTGGAAATCAAACGTACGGTGGCTGCACCATCTGTCTTC ATCTTCCCACCTTCCGACGAGCAGTTGAAGTCCGGCACCGCTTCTGTGTGCCTGC TGAACAACTTCTACCCCCGCGAGGCCAAGGTGCAGTGGAAGGTGGACAACGCCCTGCA GTCCGGCAACTCCCAGGAATCCGTGACGAGCAGGACAGCACCTACTCC CTGTCCTCCACCCTGACCCTGAGCAAGGCCGACTACGAGAAGCACAAAGTGTACGCCT GCGAAGTGACCCCACCAGGGCCTGCTAGCCCCGTGACCAAGTCTTTCAACCGGGGCGA GTGT |
| 48 | NORI-002 | Amino acid sequence of CDRH1 (IMGT) | GFTFGDFG |
| 49 | NORI-002 | Amino acid sequence of CDRH2 (IMGT) | IRSKPYGGTT |
| 50 | NORI-002 | Amino acid sequence of CDRH3 (IMGT) | SRNEILTGYYIFDY |
| 51 | NORI-002 | Amino acid sequence of CDRH1 (KABAT) | DFGMS |
| 52 | NORI-002 | Amino acid sequence of CDRH2 (KABAT) | FIRSKPYGGTTDYAPSVRG |
| 53 | NORI-002 | Amino acid sequence of CDRH3 (KABAT) | NEILTGYYIFDY |
| 54 | NORI-002 | Heavy chain variable region | EVQLVESGGGLVKPGRSLRLSCTGSGFTFGDFGMSWFRQAPGKGLEWVCFIRSKPYGG TTDYAPSVRGRFSISRDDSKGIVYLQMNSLRTEDTAVYYCSRNEILTGYYIFDYWGQG TLVTVSS |

-continued

| SEQ ID NO | | Description | Sequence |
|---|---|---|---|
| 55 | NORI-002 | Heavy chain variable region | Nucleic acid sequence of VH | GAGGTTCAGTTGGTGGAATCTGGGGGAGGCTTGGTAAAGCCAGGCGGTCCCTGAGAC TCTCCTGTACAGGTTCTGGATTCACCTTTGGTGATTTTGGTATGAGCTGGTTCCGTCA GGCTCCAGGGAAGGGGCTGGAGTGGGTATGTTTCATTAGAAGCAAACCCTATGGTGGA ACAACAGATTACGCCCGTCTGTGAGAGGCGCAGATTCAGCATCTCAAGAGATGATTCCA AAGGCATCGTCTATCTACAGATGAACAGCCTGAGAACCGAGGACACAGCCGTCTATTA TTGTAGTAGAAACGAAATTTGACTGGTTATTATATCTTTGACTACTGGGGCCAGGGA ACCCTGGTCACCGTCTCCTCA |
| 56 | NORI-002 | Full heavy chain sequence | Amino acid sequence heavy chain | EVQLVESGGGLVKPGRSLRLSCTGSGFTFGDFGMSWFRQAPGKGLEWVCFIRSKPYGG TTDYAPSVRGRFSISRDDSKGIVYLQMNSLRTEDTAVYYCSRNEILTGYYIFDYWGQG TLVTVSSASTKGPSVFPLAPCSRSTSESTAALGCLVKDYFPEPVTVSWNSGALTSGVH TFPAVLQSSGLYSLSSVVTVPSSSLGTKTYTCNVDHKPSNTKVDKRVESKYGPPCPPC PAPEFEGGPSVFLFPPKPKDTLMISRTPEVTCVVVDVSQEDPEVQFNWYVDGVEVHNA KTKPREEQFNSTYRVVSVLTVLHQDWLNGKEYKCKVSNKGLPSSIEKTISKAKGQPRE PQVYTLPPSQEEMTKNQVSLTCLVKGFYPSDIAVEWESNGQPENNYKTTPPVLDSDGS FFLYSRLTVDKSRWQEGNVFSCSVMHEALHNHYTQKSLSLSLGK |
| 57 | NORI-002 | Full heavy chain sequence | Nucleic acid sequence heavy chain | GAGGTTCAGTTGGTGGAATCTGGGGGAGGCTTGGTAAAGCCAGGCGGTCCCTGAGAC TCTCCTGTACAGGTTCTGGATTCACCTTTGGTGATTTTGGTATGAGCTGGTTCCGTCA GGCTCCAGGGAAGGGGCTGGAGTGGGTATGTTTCATTAGAAGCAAACCCTATGGTGGA ACAACAGATTACGCCCGTCTGTGAGAGGCGCAGATTCAGCATCTCAAGAGATGATTCCA AAGGCATCGTCTATCTACAGATGAACAGCCTGAGAACCGAGGACACAGCCGTCTATTA TTGTAGTAGAAACGAAATTTGACTGGTTATTATATCTTTGACTACTGGGGCCAGGGA ACCCTGGTCACCGTCTCCTCAGCCTCCACCAAGGGCCCATCGGTCTTCCCCCTGGCGCCC CTTGCGCAGGACCACCTCCGAATCCACCAGCTGGTGCCCTGGTCTGTCTGTGAAGGACTA CTTTCCCGAGCCCGTGACCGTGAGCTGGAACAGCGGCGCTCTACTCCCTGTCTCCGGCGTCCAC ACCTTCCCTGCTGTCCTGCAGTCCTCAGGACTCTACTCCCTCAGCAGCGTGGTGACCG TGCCCTAGCTCCCTCCCTGGCACCAAGACCTACACCTGCAACGTGGACCACAAACCCTC CAACACCAAGGTGGACAAACGGGTCGAGAGCAAGTACGGCCCTCCCTGCCCTCCTTGT CCTGCCCCCGAGTTCGAAGGCGGACCCAGCGTGTTCCTGTTTCCCCTGAGATGATTGGAGCCA GGAGGACAAAGCCCCGGAAGAGCAGTTCAACTCCACCTACAGGGTGGTCAGCGTGCTGA CCGTGCTGCATCAGGACTGGCTGAACGGCAAGGAGTACAAGTGCAAGGTCAGCAATAA GGGACTGCCCAGCAGCATCGAGAAGACCATCTCCAAGGCTAAAGGCCAGCCCCGGGAA CCTCAGGTGTACACCCTGCCTCCCAGCCAGGAGGAGATGACCAAGAACCAGGTGAGCC TGACCTGCCTGGTGAAGGGATTCTACCCTTCCGACATCGCCGTGGAGTGGGAGTCCAA CGGCCAGCCCGAGAACAATTATAAGACCACCCCTCCCGTCCTGGACAGCGACGGATCC TTCTTTCTGTACTCCAGGCTGACCGTGGATAAGTCCAGGTGGCAGGAAGGCAACGTGT TCAGCTGCTCCGTGATGCACGAGGCCCTGCACAATCACTACACCCAGAAGTCCCTGAG CCTGTCCCTGGGAAAG |
| 58 | NORI-002 | CDRL1 (IMGT) | Amino acid sequence of CDRL1 using IMGT | HDITNY |
| 59 | NORI-002 | CDRL2 (IMGT) | Amino acid sequence of CDRL2 using IMGT | DAS |
| 60 | NORI-002 | CDRL3 (IMGT) | Amino acid sequence of CDRL3 using IMGT | QQYYNLPLT |

-continued

| SEQ ID NO | | Description | Sequence |
|---|---|---|---|
| 61 | NORI-002 | CDRL1 (KABAT) | Amino acid sequence of CDRL1 using KABAT | QASHDITNYLI |
| 62 | NORI-002 | CDRL2 (KABAT) | Amino acid sequence of CDRL2 using KABAT | DASILET |
| 60 | NORI-002 | CDRL3 (KABAT) | Amino acid sequence of CDRL3 using KABAT | QQYYNLPLT |
| 63 | NORI-002 | Light chain variable region | Amino acid sequence of VL | DIQMTQSPSSLSASLGDRVTITCQASHDITNYLIWYQQKPGKAPRLLIFDASILETGV PSRFSGSGSGTDFTFTISSLQPEDFATYYCQQYYNLPLTFGGGTKVDIK |
| 64 | NORI-002 | Light chain variable region | Nucleic acid sequence of VL | GACATCCAGATGACCCAGTCTCCATCCTCCCTGTCTGCTTCTTTAGGAGACAGAGTCA CCATCACTTGCCAGGCGAGTCAGGCCATGACATTACCAACTATTTGATTTGGTATCAGCAGAA ACCGGGGAAAGCCCCTAGACTCCTTATCTTCGATGCATCCATTTTGGAAACAGGGGTC CCATCAAGGTTCAGTGGAAGTGGATCTGGGACAGATTTACTTTCACCATCAGCAGCC TGCAGCCTGAAGATTTTGCAACAATTACTGTCAACAATATTATAATCTCCCGCTCAC TTTCGGCGGAGGGAACCAAGGTGGACATCAAA |
| 65 | NORI-002 | Full light chain sequence | Amino acid sequence light chain | DIQMTQSPSSLSASLGDRVTITCQASHDITNYLIWYQQKPGKAPRLLIFDASILETGV PSRFSGSGSGTDFTFTISSLQPEDFATYYCQQYYNLPLTFGGGTKVDIKRTVAAPSVF IFPPSDEQLKSGTASVVCLLNNFYPREAKVQWKVDNALQSGNSQESVTEQDSKDSTYS LSSTLTLSKADYEKHKVYACEVTHQGLSSPVTKSFNRGEC |
| 66 | NORI-002 | Full light chain sequence | Nucleic acid sequence light chain | GACATCCAGATGACCCAGTCTCCATCCTCCCTGTCTGCTTCTTTAGGAGACAGAGTCA CCATCACTTGCCAGGCGAGTCAGGCCATGACATTACCAACTATTTGATTTGGTATCAGCAGAA ACCGGGGAAAGCCCCTAGACTCCTTATCTTCGATGCATCCATTTTGGAAACAGGGGTC CCATCAAGGTTCAGTGGAAGTGGATCTGGGACAGATTTACTTTCACCATCAGCAGCC TGCAGCCTGAAGATTTTGCAACAATTACTGTCAACAATATTATAATCTCCCGCTCAC TTTCGGCGGAGGGAACCAAGGTGGACATCAAACGTACGGTGGCCGCTCCCTCCGTGTTC ATCTTCCCACCTTCCGACGAGCAGCTGAAGTCCGGCACCGCTTCTGTGTGCCTGC TGAACAACTTCTACCCCGCGGAGGCCAAGGTGCAGTGGAAGGTGGACAACGCCCTGCA GTCCGGCAACTCCCAGGAATCCGTGACCGAGCAGGACTCCAAGGACAGCACCTACTCC CTGTCCTCCACCCTGACCCTGTCCAAGGCCGACTACGAGAAGCACAAGGTGTACGCCT GCGAAGTGACCCCGCTTGTCAGGCCTGACCCCGTGACCAAGTCTTTCAACCGGGGCGA GTGT |
| 48 | NORI-003 | CDRH1 (IMGT) | Amino acid sequence of CDRH1 using IMGT | GFTFGDFG |
| 49 | NORI-003 | CDRH2 (IMGT) | Amino acid sequence of CDRH2 using IMGT | IRSKPYGGTT |
| 50 | NORI-003 | CDRH3 (IMGT) | Amino acid sequence of CDRH3 using IMGT | SRNELITGYYIFDY |
| 51 | NORI-003 | CDRH1 (KABAT) | Amino acid sequence of CDRH1 using Kabat | DFGMS |

-continued

| SEQ ID NO | | Description | Sequence |
|---|---|---|---|
| 52 | NORI-003 | CDRH2 (KABAT) | Amino acid sequence of CDRH2 using Kabat | FIRSKPYGGTTDYAPSVRG |
| 53 | NORI-003 | CDRH3 (KABAT) | Amino acid sequence of CDRH3 using Kabat | NEILTGYYIFDY |
| 67 | NORI-003 | Heavy chain variable region | Amino acid sequence of VH | EVQLVESGGGLVKPGRSLRLSCTGSSGFTFGDFGMSWFRQAPGKGLEWVGFIRSKPYGG TTDYAPSVRGRFSISRDDSKGIVYLQMNSLRTEDTAVYYCSRNEILTGYYIFDYWGQG TLVTVSS |
| 68 | NORI-003 | Heavy chain variable region | Nucleic acid sequence of VH | GAGGTTCAGTTGGTGGAATCTGGGGAGGCTTGGTAAAGCCAGGGCGGTCCTGAGAC TCTCCTGCACAGGTTCTGGATTCACCTTTGGTGATTTTGGTATGAGCTGGTTCCGTCA GGCTCCAGGGAAGGGGCTGGAGTGGGTAGGTTTCATTAGAAGCAAACCTATGGTGGA ACAACAGATTACGCCCCGTCTGTGAGGGCAGATTCAGCATCTCAAGAGATGATTCCA AAGGCATCGTCTATCTACAGATGAACAGCCTGAGGACCGAGGACACCAGCCGTCTATTA TTGTAGTAGAAACGAAATTTTGACTGGTTATTATATCTTTGACTACTGGGGCCAGGGA ACCCTGGTCACCGTCTCCTCA |
| 69 | NORI-003 | Full heavy chain sequence | Amino acid sequence heavy chain | EVQLVESGGGLVKPGRSLRLSCTGSSGFTFGDFGMSWFRQAPGKGLEWVGFIRSKPYGG TTDYAPSVRGRFSISRDDSKGIVYLQMNSLRTEDTAVYYCSRNEILTGYYIFDYWGQG TLVTVSSASTKGPSVFPLAPCSRSTSESTAALGCLVKDYFPEPVTVSWNSGALTSGVH TFPAVLQSSGLYSLSSVVTVPSSSLGTKTYTCNVDHKPSNTKVDKRVESKYGPPCPPC PAPEFEGGPSVFLFPPKPKDTLMISRTPEVTCVVVDVSQEDPEVQFNWYVDGVEVHNA KTKPREEQFNSTYRVVSVLTVLHQDWLNGKEYKCKVSNKGLPSSIEKTISKAKGQPRE PQVYTLPPSQEEMTKNQVSLTCLVKGFYPSDIAVEWESNGQPENNYKTTPPVLDSDGS FFLYSRLTVDKSRWQEGNVFSCSVMHEALHNHYTQKSLSLSLGK |
| 70 | NORI-003 | Full heavy chain sequence | Nucleic acid sequence heavy chain | GAGGTTCAGTTGGTGGAATCTGGGGAGGCTTGGTAAAGCCAGGGCGGTCCTGAGAC TCTCCTGCACAGGTTCTGGATTCACCTTTGGTGATTTTGGTATGAGCTGGTTCCGTCA GGCTCCAGGGAAGGGGCTGGAGTGGGTAGGTTTCATTAGAAGCAAACCTATGGTGGA ACAACAGATTACGCCCCGTCTGTGAGGGCAGATTCAGCATCTCAAGAGATGATTCCA AAGGCATCGTCTATCTACAGATGAACAGCCTGAGGACCGAGGACACCAGCCGTCTATTA TTGTAGTAGAAACGAAATTTTGACTGGTTATTATATCTTTGACTACTGGGGCCAGGGA ACCCTGGTCACCGTCTCCTCAGCTTCCACCAAGGGCCCATCGGTCTTCCCCCTGGCCC CTTGCAGCAGGAGCACCTCCGAATCCACAGCTGCCCTGGGCTGTCTGGTGAAGGACTA CTTCCCCGAGCCCGTGACCGTGAGCTGGAACAGCGGCGCCCTGACATCCGGCGTCCAC ACCTTTCCTGCCGTGCTGCAGTCCTCCGGGCTCTACTCCCTGTCCTCCGTGGTGACCG TGCCTAGCTCCTCCCTGGCACCAAGAACCTACACCTGTAACGTGGACCACAAACCCTC CAACACCAAGGTGGACAAACGGGTGGAGAGCAAGTACGGCCCTCCCTGCCCTCCTTGT CCTGCCCCCGAGTTCGAAGGCGGACCCAGCGTGTTCCTGTTCCCCCCAAGGCCCAAGG ACACCCTCATGATCAGCCGGACCCAGGTGACCTGCGTGGTGGTGGATGTGAGCCA GGAGGACCCTGAGGTCCAGTTCAACTGGTATGTGGATGGCGTGGAGGTGCACAACGCC AAGACAAAGCCCCGGGAAGAGCAGTTCAACTCCACCTACAGGGTGGTGCAGCGTGCTGA CCGTGCTGCATCAGGACTGGCTGAACGGCAAGGAGTACAAGTGCAAGGTCAGCAATAA GGGACTGCCCAGCAGCATCGAGAAGACCATCTCAAGGCTAAAGGCCAGCCCGGGAA CCTCAGGTGTACACCCTGCCTCCCCAGCCAGGAGAGATGACCAAGAACCAGGTGAGCC TGACCTGCCTGGTGAAGGGATTCTACCCTTCCGACATCGCCGTGGAGTGGGAGTCCAA |

-continued

| SEQ ID NO | | Description | Sequence |
|---|---|---|---|
| | | | CGGCCAGCCCGAGAACAATTATAAGACCACCCCTCCCGTCCTCTGACAGCGACGGATCC TTCTTTCTGTACTCCAGGCTGACCGTGGATAAGTCCAGGTGGCAGGAAGGCAACGTGT TCAGCTGCTCCGTGATGCACGAGGCCCTGCACAATCACTACACCCAGGAAGTCCCTGAG CCTGTCCCTGGGAAAG |
| 58 | NORI-003 | Amino acid sequence of CDRL1 (IMGT) | HDITNY |
| 59 | NORI-003 | Amino acid sequence of CDRL2 (IMGT) | DAS |
| 60 | NORI-003 | Amino acid sequence of CDRL3 (IMGT) | QQYYNLPLT |
| 61 | NORI-003 | Amino acid sequence of CDRL1 (KABAT) | QASHDITNYLI |
| 62 | NORI-003 | Amino acid sequence of CDRL2 (KABAT) | DASILET |
| 60 | NORI-003 | Amino acid sequence of CDRL3 (KABAT) | QQYYNLPLT |
| 63 | NORI-003 | Amino acid sequence of VL | DIQMTQSPSSLSASLGDRVIITCQASHDITNYLIWYQQKPGKAPRLLIFDASILETGV PSRFSGSGSGTDFTFTISSLQPEDFATYYCQQYYNLPLTFGGGTKVDIK |
| 71 | NORI-003 | Nucleic acid sequence of VL | GACATCCAGATGACCCAGTCTCCATCCTCCCTGTCTGCTTCTTTAGGAGACAGAGTCA CCATCACTTGCCAGGCGAGTCATGACATTACCAACTATTTGATTTGGTATCAGCAGAA ACCGGGGAAAGCCCCTAGACTCCTTATCTTCGATGCATCCATCTTGGAAACAGGGGTC CCATCAAGGTTCAGTGGAAGTGGATCTGGGACAGATTTTACTTTCACCATCAGCAGCC TGCAGCCTGAAGATTTTGCAACATATTACTGTCAACAATATTATAATCTCCCGCTCAC TTTCGGCGGAGGAACCAAGGTGGACATCAAA |
| 65 | NORI-003 | Amino acid sequence light chain | DIQMTQSPSSLSASLGDRVIITCQASHDITNYLIWYQQKPGKAPRLLIFDASILETGV PSRFSGSGSGTDFTFTISSLQPEDFATYYCQQYYNLPLTFGGGTKVDIKRTVAAPSVF IFPPSDEQLKSGTASVVCLLNNFYPREAKVQWKVDNALQSGNSQESVTEQDSKDSTYS LSSTLTLSKADYEKHKVYACEVTHQGLSSPVTKSFNRGEC |
| 72 | NORI-003 | Nucleic acid sequence light chain | GACATCCAGATGACCCAGTCTCCATCCTCCCTGTCTGCTTCTTTAGGAGACAGAGTCA CCATCACTTGCCAGGCGAGTCATGACATTACCAACTATTTGATTTGGTATCAGCAGAA ACCGGGGAAAGCCCCTAGACTCCTTATCTTCGATGCATCCATCTTGGAAACAGGGGTC CCATCAAGGTTCAGTGGAAGTGGATCTGGGACAGATTTTACTTTCACCATCAGCAGCC TGCAGCCTGAAGATTTTGCAACATATTACTGTCAACAATATTATAATCTCCCGCTCAC TTTCGGCGGAGGAACCAAGGTGGACATCAAACGTACGGTGGCCGCTCCCAGTCGTTTC ATCTTCCCACCTTCCGACGAGCAGCTGAAGTCCGGCACCGCTTCTGTGGTGTGCCTGC TGAACAACTTCTACCCCCGCGAGGCCAAGGTGCAGTGGAAGGTGGACAACGCCCTGCA |

-continued

| SEQ ID NO | | Description | Sequence |
|---|---|---|---|
| 48 | NORI-004 | | GTCCGGCAACTCCCAGGAATCCGTGACCGAGCAGGACTCCAAGGACAGCACCTACTCC CTGTCCTCCACCCTGACCCTGTCCAAGGCCGACTACGAGAAGCACCAAGGTGTACGCCT GCGAAGTGACCCACCAGGGCCTGTCTAGCCCCGTGACCAAGTCTTTCAACCGGGGCGA GTGT |
| | | Amino acid sequence of CDRH1 using IMGT | |
| | CDRH1 (IMGT) | | GFTFGDFG |
| 49 | NORI-004 | | |
| | | Amino acid sequence of CDRH2 using IMGT | |
| | CDRH2 (IMGT) | | IRSKPYGGTT |
| 50 | NORI-004 | | |
| | | Amino acid sequence of CDRH3 using IMGT | |
| | CDRH3 (IMGT) | | SRNEILTGYYIFDY |
| 51 | NORI-004 | | |
| | | Amino acid sequence of CDRH1 using Kabat | |
| | CDRH1 (KABAT) | | DFGMS |
| 73 | NORI-004 | | |
| | | Amino acid sequence of CDRH2 using Kabat | |
| | CDRH2 (KABAT) | | FIRSKPYGGTTDYAPSVKD |
| 53 | NORI-004 | | |
| | | Amino acid sequence of CDRH3 using Kabat | |
| | CDRH3 (KABAT) | | NEILTGYYIFDY |
| 74 | NORI-004 | | |
| | | Amino acid sequence of VH | |
| | Heavy chain variable region | | EVQLVESGGGLVKPGRSLRLSCTGSGFTFGDFGMSWFRQAPGKGLEWVCFIRSKPYGG TTDYAPSVKDRFTISRDDSKDIVYLQMNSLRTEDTAVYYCSRNEILTGYYIFDYWGQG TLVTVSS |
| 75 | NORI-004 | | |
| | | Nucleic acid sequence of VH | |
| | Heavy chain variable region | | GAGGTGCAGTTGGTGGAATCTGGGGGAGGCGTTGGTAAAGCCAGGGCGGTCCCTGAGAC TCTCCTGTACAGGTCTGGATTCACCTTTGGTGATTTGGTATGAGCTGGTTCCGTCA GGCGCCAGGGAGGGGCTGGAGTGGGTATGTTCATTAGAAGCAAACCCTATGGTGGA ACAACAGATTACGCCCCGTCTGTGAAAGACAGATTCACCATCTCAAGAGATGATTCCA AAGACATCGTCTATCTGCAAATGAACAGCCTGAGAACCGAGGACACCAGCCGTCTATTA TTGTAGTAGAAACGAAATTTGACTGGTTATTATATCTTTGACTACTGGGGCCAGGGA ACCCTGGTCACCGTCTCCTCA |
| 76 | NORI-004 | | |
| | | Amino acid sequence heavy chain | |
| | Full heavy chain sequence | | EVQLVESGGGLVKPGRSLRLSCTGSGFTFGDFGMSWFRQAPGKGLEWVCFIRSKPYGG TTDYAPSVKDRFTISRDDSKDIVYLQMNSLRTEDTAVYYCSRNEILTGYYIFDYWGQG TLVTVSSASTKGPSVFPLAPCSRSTSESTAALGCLVKDYFPEPVTVSWNSGALTSGVH TFPAVLQSSGLYSLSSVVTVPSSSLGTKTYTCNVDHKPSNTKVDKRVESKYGPPCPPC PAPEFEGGPSVFLFPPKPKDTLMISRTPEVTCVVVDVSQEDPEVQFNWYVDGVEVHNA KTKPREEQFNSTYRVVSVLTVLHQDWLNGKEYKCKVSNKGLPSSIEKTISKAKGQPRE PQVYTLPPSQEEMTKNQVSLTCLVKGFYPSDIAVEWESNGQPENNYKTTPPVLDSDGS FFLYSRLTVDKSRWQEGNVFSCSVMHEALHNHYTQKSLSLSLGK |
| 77 | NORI-004 | | |
| | | Nucleic acid sequence heavy chain | |
| | Full heavy chain sequence | | GAGGTGCAGTTGGTGGAATCTGGGGGAGGCGTTGGTAAAGCCAGGGCGGTCCCTGAGAC TCTCCTGTACAGGTCTGGATTCACCTTTGGTGATTTGGTATGAGCTGGTTCCGTCA GGCGCCAGGGAGGGGCTGGAGTGGGTATGTTCATTAGAAGCAAACCCTATGGTGGA ACAACAGATTACGCCCCGTCTGTGAAAGACAGATTCACCATCTCAAGAGATGATTCCA AAGACATCGTCTATCTGCAAATGAACAGCCTGAGAACCGAGGACACCAGCCGTCTATTA TTGTAGTAGAAACGAAATTTGACTGGTTATTATATCTTTGACTACTGGGGCCAGGGA |

-continued

| SEQ ID NO | | Description | Sequence |
|---|---|---|---|
| | | | ACCCTGGTCACCGTCTCCTCAGCCAGCACCAAGGGCCCTTCCGTGTTCCCCCTGGCCC CTTGCAGCAGGAGCACCTCCGAATCCGAATCCACAGCTGCCCTGGGCTGTCTGGTGAAGGACTA CTTTCCCGAGCCCGTGACCGTGAGCTGGAACAGCGGCGCGTCCTGACATCCGGCGTCCAC ACCTTTCCTGCCGTCTCCAGTCTCCTGGGCCTTCTACTCCCTGTCTCCCGTGGTGACCG TGCCTAGCTCCTCCCTGGCACCAAGACCTACACCTGTAACGTGGACCACAAACCCTC CAACACCAAGGTGACAAACGTGGACAAGGGTCGAGAGCAAGGTGCGCCCTCCGTGCCCTCCTTGT CCTGCCCCCGAGTTCGAAGGCGACCCAGCGTGTTCCTGTTCCCCTCCAAGGG ACACCCTCATGATCAGCCGGACACCCGAGGTGACCTGCGTGGTGGTGGATGTGAGCCA GGAGGACCCCGAGGTGCAGTTCAACTGGTATGTGGATGGCGTGGAGGTGCACAACGCC AAGACAAAGCCCCGGGAGGAGCAGTTCAACTCCACCTACAGGGTGGTGAGCGTGCTGA CCGTGCTGCATCAGGACTGGCTGAACGGCAAGGAGTACAAGTGCAAGGTCAGCAATAA GGGACTGCCCAGCAGCATCGAGAAGACCATCTCCAAGGCTAAAGGCCAGCCCCGGGAA CCTCAGGTGTACACCCTGCCTCCAAGCCAAGAAGAGATGACCAAGAACCAGGTGAGCC TGACCTGCCTGGTGAAGGGATTCTACCCTTCCGACATCGCCGTGGAGTGGGAGTCCAA CGGCCAGCCCGAGAACAATTATAAGACCACCCCTCCCGTGCTCGACAGCGACGGATCC TTCTTTCTGTACTCCAAGCTGACCGTGGATAAGAGCAGGTGGCAGCAGGGCAACGTGT TCAGCTGCTCCGTGATGCACGAGGCCCTGCACAATCACTACACCCAGAAGTCCCTGAG CCTGTCCCTGGGAAAG |
| 58 | NORI-004 | CDRL1 (IMGT) | Amino acid sequence of CDRL1 using IMGT HDITNY |
| 59 | NORI-004 | CDRL2 (IMGT) | Amino acid sequence of CDRL2 using IMGT DAS |
| 60 | NORI-004 | CDRL3 (IMGT) | Amino acid sequence of CDRL3 using IMGT QQYYNLPLT |
| 61 | NORI-004 | CDRL1 (KABAT) | Amino acid sequence of CDRL1 using KABAT QASHDITNYLI |
| 62 | NORI-004 | CDRL2 (KABAT) | Amino acid sequence of CDRL2 using KABAT DASILET |
| 60 | NORI-004 | CDRL3 (KABAT) | Amino acid sequence of CDRL3 using KABAT QQYYNLPLT |
| 63 | NORI-004 | Light chain variable region | Amino acid sequence of VL DIQMTQSPSSLSASLGDRVTITCQASHDITNYLIWYQQKPGKAPRLLIFDASILETGV PSRFSGSGSGTDFTFTISSLQPEDFATYYCQQYYNLPLTFGGGTKVDIK |
| 78 | NORI-004 | Light chain variable region | Nucleic acid sequence of VL GACATCCAGATGACCCAGTCTCCATCCTCCCTGTCTGCTTCTTTAGGAGACAGAGTCA CCATCACTTGCCAGGCGAGTCATGACATTACCAACTATTTGATTTGGTATCAGCAGAA ACCGGGGAAAGCCCCTAGACTCCTTATCTTCGATGCATCCATTTTGGAAACAGGGGTC CCATCAAGGTTCAGTGGAAGTGGATCTGGGACAGATTTTACTTTCACCATCAGCAGCC TGCAGCCTGAAGATTTTGCAACATATTACTGTCAACAATATTATAATTTGCCGCTCAC TTTCGGCGGAGGGACCAAGGTGGACATCAAA |

-continued

| SEQ ID NO | | Description | Sequence |
|---|---|---|---|
| 65 | NORI-004 | Full light chain sequence | Amino acid sequence light chain | DIQMTQSPSSLSASLGDRVTITCQASHDITNYLIWYQQKPGKAPRLLIFDASILETGV<br>PSRFSGSGSGTDFTFTISSLQPEDFATYYCQQYYNLPLTFGGGTKVDIKRTVAAPSVF<br>IFPPSDEQLKSGTASVVCLLNNFYPREAKVQWKVDNALQSGNSQESVTEQDSKDSTYS<br>LSSTLTLSKADYEKHKVYACEVTHQGLSSPVTKSFNRGEC |
| 79 | NORI-004 | Full light chain sequence | Nucleic acid sequence light chain | GACATCCAGATGACCCAGTCTCCATCCTCCCTGTCTGCTTCTTTAGGAGACAGAGTCA<br>CCATCACTTGCCAGGCGAGTCATGACATTACCAACTATTTGATTTGGTATCAGCAGAA<br>ACCGGGGAAAGCCCTAGATCTTCTTATCTTCGATGCATCCATTTGGAAACAGGGGTC<br>CCATCAAGGTTCAGTGGAAGTGGATCTGGGACAGATTTTACTTTCACCATCAGCAGCC<br>TGCAGCCTGAAGATTTTGCAACATATTACTGTCAACAATATTATAATTGCCTGCTCAC<br>TTTCGGCGGAGGGACCAAGGTGGACATCAAACGTACGGTGGCCGCTCCCTCCGTGTTC<br>ATCTTCCCACCTTCCACCCGCGGAGGCCAAGGTGCAAGTGCCTCTGTGTGCCTGC<br>TGAACAACTTCTACCCCCGGAGGCCAAGGTGACCGTCCAGGACTCCAGGACGACACTCC<br>GTCCGGCAACTCCACCCGCCGAGTCCGTGACCGAGCAGGACAGCAGCACAACCCCTGCA<br>CTGTCCTCCACCCTGACCCTGCTCAGCAAGGCCGACTACGAGAAGCACAAAGTGTACGCCT<br>GCGAAGTGACCCACCAGGGCCTGTCTAGCCCCGTGACCAAGAGCTTTCAACCGGGGCGA<br>GTGT |
| 48 | NORI-005 | CDRH1 (IMGT) | Amino acid sequence of CDRH1 using IMGT | GFTFGDFG |
| 49 | NORI-005 | CDRH2 (IMGT) | Amino acid sequence of CDRH2 using IMGT | IRSKPYGGTT |
| 80 | NORI-005 | CDRH3 (IMGT) | Amino acid sequence of CDRH3 using IMGT | ARNEILTGYYIFDY |
| 81 | NORI-005 | CDRH1 (KABAT) | Amino acid sequence of CDRH1 using Kabat | DFGLS |
| 82 | NORI-005 | CDRH2 (KABAT) | Amino acid sequence of CDRH2 using Kabat | FIRSKPYGGTTDYAASVKG |
| 53 | NORI-005 | CDRH3 (KABAT) | Amino acid sequence of CDRH3 using Kabat | NEILTGYYIFDY |
| 83 | NORI-005 | Heavy chain variable region | Amino acid sequence of VH | EVHLVESGGGLIKPGRSLRLSCTGSGFTFGDFGLSWFRQAPGKGLEWISFIRSKPYGG<br>TTDYAASVKGRFTISRDDSKSVAYLQMNSLKTEDSAVYYCARNEILTGYYIFDYWGQG<br>ILVTVSS |
| 84 | NORI-005 | Heavy chain variable region | Nucleic acid sequence of VH | GAGGTACACCTGGTGGAGTCTGGGGGAGGCTTGGTGATAAAGCCAGGGCGGTCCCTGAGAC<br>TCTCCTGTACAGGTTCGGATTCACCTTTGGTGATTTGGTCTGAGTTGGTTCCGCCA<br>GGCTCCAGGGAAGGGGCTGGAATGGATATCTTCATCAGAAGAGCAAACCTTATGGTGGG<br>ACAACAGATTACGCCGCCTATCTGCAAATGAACAGCCTGAAAACCGAGGACTCAGCCGTGTATTA<br>AAAGCCTCGCCTATCTGCAAATGAACAGCCTGAAAACCGAGGACTCAGCCGTGTATTA<br>CTGTGCCAGAAACGAGATTTTGACTGGTTACTATATCTTTGACTACTGGGGCCAGGGA<br>ATCCTGGTCACCGTCTCCTCA |
| 85 | NORI-005 | Full heavy chain sequence | Amino acid sequence heavy chain | EVHLVESGGGLIKPGRSLRLSCTGSGFTFGDFGLSWFRQAPGKGLEWISFIRSKPYGG<br>TTDYAASVKGRFTISRDDSKSVAYLQMNSLKTEDSAVYYCARNEILTGYYIFDYWGQG<br>ILVTVSSASTKGPSVFPLAPCSRSTSESTAALGCLVKDYFPEPVTVSWNSGALTSSVH |

| SEQ ID NO | | Description | Sequence |
|---|---|---|---|
| | | | TFPAVLQSSGLYSLSSVVTVPSSSLGTKTYTCNVDHKPSNTKVDKRVESKYGPPCPPC |
| | | | PAPEFEGGPSVFLFPPKPKDTLMISRTPEVTCVVVDVSQEDPEVQFNWYVDGVEVHNA |
| | | | KTKPREEQFNSTYRVVSVLTVLHQDWLNGKEYKCKVSNKGLPSSIEKTISKAKGQPRE |
| | | | PQVYTLPPSQEEMTKNQVSLTCLVKGFYPSDIAVEWESNGQPENNYKTTPPVLDSDGS |
| | | | FFLYSRLTVDKSRWQEGNVFSCSVMHEALHNHYTQKSLSLSLGK |
| 86 | NORI-005 | Full heavy chain sequence | GAGGTACACCTGGTGAGTCTGGGGGAGGCTTGATAAAGCCAGGGCGGTCCCTGAGAC |
| | | Nucleic acid sequence heavy chain | TCTCCTGACAGGTTCTGGATTCACCTTTGGTGATTTGGTCTGAGTTGGTTCCGCCA |
| | | | GGCTCCAGGGAAGGGGGCTGGAATGGATATCTTTCATCAGAAGCAAACCTTATGGTGGG |
| | | | ACAACAGATTACGCCGCCTCTGTGAAAGGCAGATTCACCATTTCAAGAGATGATTCCA |
| | | | AAAGCCTCGCCTATCTGCAAATGAACAGCCTGAAAACCGAGGACTCAGCCGTGTATTA |
| | | | CTGTGCCAGAAACGAGATTTTGACTGGTTACTATATCTTTGACTACTGGGGCCAGGGA |
| | | | ATCCTGGTCACCGTCTCCTCAGCCACCAAGGGCCCTTCCGTGTTCCCCCTGGCCC |
| | | | CTTGCGAGGAGCACCTCCGAATCCACAGCTGCCCTGGGCTGTCTGCTGGTGAAGGACTA |
| | | | CTTTCCCGAGCCCGTGACCGTGAGCTGGAACAGCGGCGCTCTGACCATCCGGCGTCCAC |
| | | | ACCTTTCCTGCCTCCAGTCTCCTCGGCCTTACCTCCCTGTCTCCGTGGTGACCG |
| | | | TGCCTAGCTCCTCCCTGCAACGACCTACACCTGTAACGTGGACCACCAAAACCCTC |
| | | | CAACACCAAGGTGGACAAAACGGGTCGAGAGCAAGTACGGCCCTCCCTGCCCTCCTTGT |
| | | | CCTGCCCCCGAGTTCGAAGGCGGACCCAGCGTGTTCCTGTTCCCTCCTAAGCCCAAGG |
| | | | ACACCCTCATGATCAGCCGGACACCCGAGGTGACCTGCGTGGTGGTGGATGTGAGCCA |
| | | | GGAGGACCCTGAGGTCCAGTTCAACTGGTATGTGGATGGCGTGGAGGTGCACAACGCC |
| | | | AAGACAAAGCCCCGGGAAGAGCAGTTCAACTCCACCTACAGGGTGGTCAGCGTGCTGA |
| | | | CCGTGCTGCATCAGGACTGGCTGAACGGCAAGGAGTACAAGTGCAAGGTCAGCAATAA |
| | | | GGGACTGCCCAGCAGCATCGAGAAGACCATCTCCAAGGCTAAAGGCCAGCCCCGGGAA |
| | | | CCTCAGGTGTACACCCTGCCTCCCAGCCAGGAGATGACCAAGAACCAGGTGAGCC |
| | | | TGACCTGCCTGGTGAAGGGATTCTACCCTTCCGACATCGCCGTGGAGTGGGAGTCCAA |
| | | | CGGCCAGCCCGAGAACAATTATAAGACCACCCCTCCCGTCGACAGCGACGGATCC |
| | | | TTCTTTCTGTACTCCAGGCTGACCGTGGATAAGTCCAGGTGGCAGGAAGGCAACGTGT |
| | | | TCAGCTGCTCCGTGATGCACGAGGCCCTGCACAATCACTACACCCAGAAGTCCCTGAG |
| | | | CCTGTCCCTGGGAAAG |
| 87 | NORI-005 | Amino acid sequence of CDRL1 using IMGT | QDISNY |
| 59 | NORI-005 | Amino acid sequence of CDRL2 using IMGT | DAS |
| 88 | NORI-005 | Amino acid sequence of CDRL3 using IMGT | QQYDNLPLT |
| 89 | NORI-005 | Amino acid sequence of CDRL1 using KABAT | QASQDISNYLS |
| 62 | NORI-005 | Amino acid sequence of CDRL2 using KABAT | DASILET |
| 88 | NORI-005 | Amino acid sequence of CDRL3 using KABAT | QQYDNLPLT |

| SEQ ID NO | | Description | Sequence |
|---|---|---|---|
| 90 | NORI-005 | Light chain variable region | Amino acid sequence of VL | DIQMTQSPSSLSASLGDRLTITCQASQDISNYLSWYQLQPGKAPKLLIFDASILETGV PSRFSGSGSGTDFSFTVSSLQPEDIATYYCQQYDNLPLTFGGGTKVDLK |
| 91 | NORI-005 | Light chain variable region | Nucleic acid sequence of VL | GACATCCAGATGACCCAGTCTCCATCCTCCCTGTCTGCTTCTTTAGGAGACAGACTCA CCATCACTTGCCAGGCGAGTCAGGACATTAGCAACTATTTAAGTTGGTATCAACTGCA ACCAGGGAAAGCCCCTAAGCTCCTGATCTTCGATGCATCCATTTTGGAAACAGGGGTC CCATCAAGGTTCAGTGGAAGTGGATCTGGGACAGATTTTCTTTCACCGTCAGTAGCC TGCAGCCTGAAGATATTGCAACATATTACTGTCAACAGTATGATAATCCCCGCTCAC TTTCGGCGGGGGGACCAAGGTGGATCTCAAA |
| 92 | NORI-005 | Full light chain sequence | Amino acid sequence light chain | DIQMTQSPSSLSASLGDRLTITCQASQDISNYLSWYQLQPGKAPKLLIFDASILETGV PSRFSGSGSGTDFSFTVSSLQPEDIATYYCQQYDNLPLTFGGGTKVDLKRTVAAPSVF IFPPSDEQLKSGTASVVCLLNNFYPREAKVQWKVDNALQSGNSQESVTEQDSKDSTYS LSSTLTLSKADYEKHKVYACEVTHQGLSSPVTKSFNRGEC |
| 93 | NORI-005 | Full light chain sequence | Nucleic acid sequence light chain | GACATCCAGATGACCCAGTCTCCATCCTCCCTGTCTGCTTCTTTAGGAGACAGACTCA CCATCACTTGCCAGGCGAGTCAGGACATTAGCAACTATTTAAGTTGGTATCAACTGCA ACCAGGGAAAGCCCCTAAGCTCCTGATCTTCGATGCATCCATTTTGGAAACAGGGGTC CCATCAAGGTTCAGTGGAAGTGGATCTGGGACAGATTTTCTTTCACCGTCAGTAGCC TGCAGCCTGAAGATATTGCAACATATTACTGTCAACAGTATGATAATCCCCGCTCAC TTTCGGCGGGGGGACCAAGGTGGATCTCAAACGAACTGTGGCTGCACCATCTGTCTTC ATCTTCCCACCTTCCAGCGAGCCGGAGGCCAAGGTGCAGTGGAAGGTGGACAACGCCCTGCA GTCCGGCAACTCCCAGGAATCCGTGACCGAGCAGGACTCCAAGGACAGCACCTACTCC CTGTCCTCCACCCTGACCCTGTCCAAGGCCGACTACGAGAAGCACAAGGTGTACGCCT GCGAGGTGACCCCGTGCTGTCTAGCCCGTGACCCAAGGTCTTTCAACCGGGGCGA GTGT |
| 48 | NORI-006 | CDRH1 (IMGT) | Amino acid sequence of CDRH1 using IMGT | GFTFGDFG |
| 49 | NORI-006 | CDRH2 (IMGT) | Amino acid sequence of CDRH2 using IMGT | IRSKPYGGTT |
| 80 | NORI-006 | CDRH3 (IMGT) | Amino acid sequence of CDRH3 using IMGT | ARNEILTGYYIFPDY |
| 81 | NORI-006 | CDRH1 (KABAT) | Amino acid sequence of CDRH1 using Kabat | DFGLS |
| 82 | NORI-006 | CDRH2 (KABAT) | Amino acid sequence of CDRH2 using Kabat | FIRSKPYGGTTDYAASVKG |
| 53 | NORI-006 | CDRH3 (KABAT) | Amino acid sequence of CDRH3 using Kabat | NEILTGYYIFDY |
| 94 | NORI-006 | Heavy chain variable region | Amino acid sequence of VH | EVQLVESGGGLIKPGRSLRLSCTGSGFTFGDFGLSWFRQAPGKGLEWISFIRSKPYGG TTDYAASVKGRFTISRDDSKNVAYLQMNSLKTEDTAVYYCARNEILTGYYIFDYWGQG TLVTVSS |

-continued

| SEQ ID NO | | Description | Sequence |
|---|---|---|---|
| 95 | NORI-006 | Heavy chain variable region<br>Nucleic acid sequence of VH | GAGGTGCAGCTGGTGGAGTCTGGGGGAGGAGGATTGATAAAGCCAGGGCGGTCCCTGAGAC<br>TCTCCTGTACAGGTTCTGGATTCACCTTTGGTGATTTGGTCTGAGCTGGTTCCGCCA<br>GGCTCCAGGGAAGGGACTGGAATGGGTATCTTTCATTAGAAGTAAACCTTATGGTGGG<br>ACAACAGATTACGCCGCCTCTGTGAAAGGCAGATTCACCATATCAAGAGATGATTCCA<br>AAAACTCGCCTATCTACAAATGAACAGCCTGAAGACCGAGGACACAGCCGTGTATTA<br>CTGTGCTAGAAACGAGATTTTGACTGGTTATTATATCTTTGACTACTGGGGCCAGGGA<br>ACCCTGGTCACCGTCTCCTCA |
| 96 | NORI-006 | Full heavy chain sequence<br>Amino acid sequence heavy chain | EVQLVESGGGLIKPGRSLRLSCTGSGFTFGDFGLSWFRQAPGKGLEWISFIRSKPYGG<br>TTDYAASVKGRFTISRDDSKNVAYLQMNSLKTEDTAVYYCARNEILTGYYIFDYWGQG<br>TLVTVSSASTKGPSVFPLAPCSRSTSESTAALGCLVKDYFPEPVTVSWNSGALTSGVH<br>TFPAVLQSSGLYSLSSVVTVPSSSLGTKTYTCNVDHKPSNTKVDKRVESKYGPPCPPC<br>PAPEFEGGPSVFLFPPKPKDTLMISRTPEVTCVVVDVSQEDPEVQFNWYVDGVEVHNA<br>KTKPREEQFNSTYRVVSVLTVLHQDWLNGKEYKCKVSNKGLPSSIEKTISKAKGQPRE<br>PQVYTLPPSQEEMTKNQVSLTCLVKGFYPSDIAVEWESNGQPENNYKTTPPVLDSDGS<br>FFLYSRLTVDKSRWQEGNVFSCSVMHEALHNHYTQKSLSLSLGK |
| 97 | NORI-006 | Full heavy chain sequence<br>Nucleic acid sequence heavy chain | GAGGTGCAGCTGGTGGAGTCTGGGGGAGGAGGATTGATAAAGCCAGGGCGGTCCCTGAGAC<br>TCTCCTGTACAGGTTCTGGATTCACCTTTGGTGATTTGGTCTGAGCTGGTTCCGCCA<br>GGCTCCAGGGAAGGGACTGGAATGGGTATCTTTCATTAGAAGTAAACCTTATGGTGGG<br>ACAACAGATTACGCCGCCTCTGTGAAAGGCAGATTCACCATATCAAGAGATGATTCCA<br>AAAACTCGCCTATCTACAAATGAACAGCCTGAAGACCGAGGACACAGCCGTGTATTA<br>CTGTGCTAGAAACGAGATTTTGACTGGTTATTATATCTTTGACTACTGGGGCCAGGGA<br>ACCCTGGTCACCGTCTCCTCAGCCACCAAGGGCCCTTCCGTGTTCCCCTGGCCC<br>CTTGCAGCAGGAGCACCTCCGAATCCACAGCTGCCCTGGGCTGTCTGGTGAAGGACTA<br>CTTTCCCGAGCCCGTGACCGTGACCTGGAACAGCGGCGCGTCTGACATCCGGCGTCCAC<br>ACCTTTCCTGCCGTCCTGCAGTCCTCCGGCCTCTACTCCCTGTCCTCCGTGGTGACCG<br>TGCCTAGCTCCTCCCTGGCACCGAGACCTACAGTGTAACGTGGACCACAAACCCTC<br>CAACACCAAGGTGGACAAGCGGGTCGAGAGCAAGTACGGCCCTCCGTGCCCTCCTTGT<br>CCTGCCCCCGAGTTCGAAGGCCGGACACCCGAGGTGACCTGCGTGGTGGTGGATGTGAGCCA<br>GGAGGACCCTGAGGTCCAGTTCAACTGGTATGTGGATGGCGTGGAGGTGCACAACGCC<br>AAGACAAAGCCCGGGAAGAGCAGTTCAACTCACCTACAGGGTGTCAGCGTGCTGA<br>CCGTGCTGCATCAGGACTGGCTGAACGGCAAGGAGTACAAGTGCAAGGTCAGCAATAA<br>GGGACTGCCCAGCAGCATCGAGAAGACCATCTCCAAGGCTAAAGGCCAGCCCCGGGAA<br>CCTCAGGTGTACACCCTGCCTCCCAGGAGGAGGAGATGACCAAGAACCAGGTGAGCC<br>TGACCTGCCTGGTGAAGGGATTCTACCCTTCCGACATCGCCGTGGAGTGGGAGTCCAA<br>CGGCCAGCCCGAGAACAATTATAAGACCACCCCTCCCGTCCTGGACAGCGACGGATCC<br>TTCTTTCTGTACTCCAGGCTGACCGTGGATAAGTCCAGGTGGCAGGAAGGCAACGTGT<br>TCAGCTGCTCCGTGATGCACGAGGCCCTGCACAATCACTACACCCAGAAGTCCCTGAG<br>CCTGTCCCTGGGAAAG |
| 98 | NORI-006 | CDRL1<br>(IMGT) | Amino acid sequence of CDRL1 using IMGT | QDINNY |
| 59 | NORI-006 | CDRL2<br>(IMGT) | Amino acid sequence of CDRL2 using IMGT | DAS |

-continued

| SEQ ID NO | | Description | | Sequence |
|---|---|---|---|---|
| 88 | NORI-006 | CDRL3 (IMGT) | Amino acid sequence of CDRL3 using IMGT | QQYDNLPLT |
| 99 | NORI-006 | CDRL1 (KABAT) | Amino acid sequence of CDRL1 using KABAT | QASQDINNYLN |
| 62 | NORI-006 | CDRL2 (KABAT) | Amino acid sequence of CDRL2 using KABAT | DASILET |
| 88 | NORI-006 | CDRL3 (KABAT) | Amino acid sequence of CDRL3 using KABAT | QQYDNLPLT |
| 100 | NORI-006 | Light chain variable region | Amino acid sequence of VL | DIQMTQSPSSLSASLGDRVTITCQASQDINNYLNWYQVQPGKAPKLLIFDASILETGV PSRFSGSGSGTDFSFTISSLQPEDIATYYCQQYDNLPLTFGGGTKVDFK |
| 101 | NORI-006 | Light chain variable region | Nucleic acid sequence of VL | GACATCCAGATGACCCAGTCTCCATCCTCCCTGTCTGCTTCTTTAGGAGACAGAGTCA CCATCACTTGCCAGGCGAGTCAGGACATTAACAACTATTTAAATTGGTATCAAGTGCA ACCAGGGAAAGCCCCTAAGCTCCTGATCTTCGATGCATCATTTGAAACAGGGGTC CCATCACGGTTCAGTGAAGTGGATCTGGGACAGAGTTTTCTTTCACCATCAGTAGCC TGCAGCCTGAAGATATTGCAACATATTACTGTCAACAATATGATAATCTCCCGCTCAC TTTCGGCGGAGGGACCAAGGTGGATTTCAAA |
| 102 | NORI-006 | Full light chain sequence | Amino acid sequence of light chain | DIQMTQSPSSLSASLGDRVTITCQASQDINNYLNWYQVQPGKAPKLLIFDASILETGV PSRFSGSGSGTDFSFTISSLQPEDIATYYCQQYDNLPLTFGGGTKVDFKRTVAAPSVF IFPPSDEQLKSGTASVVCLLNNFYPREAKVQWKVDNALQSGNSQESVTEQDSKDSTYS LSSTLTLSKADYEKHKVYACEVTHQGLSSPVTKSFNRGEC |
| 103 | NORI-006 | Full light chain sequence | Nucleic acid sequence light chain | GACATCCAGATGACCCAGTCTCCATCCTCCCTGTCTGCTTCTTTAGGAGACAGAGTCA CCATCACTTGCCAGGCGAGTCAGGACATTAACAACTATTTAAATTGGTATCAAGTGCA ACCAGGGAAAGCCCCTAAGCTCCTGATCTTCGATGCATCATTTGAAACAGGGGTC CCATCACGGTTCAGTGAAGTGGATCTGGGACAGAGTTTTCTTTCACCATCAGTAGCC TGCAGCCTGAAGATATTGCAACATATTACTGTCAACAATATGATAATCTCCCGCTCAC TTTCGGCGGAGGGACCAAGGTGGATTTCAAACGTACGGTGGCCGCTCCCTCCGTGTTC ATCTTCCCACCTTCCGACGAGCAGTTGAAGTCCGGCACCGCTTCTGTCGTGTGCCTGC TGAACAACTTCTACCCCGCGAGGCCAAGGTGCAGTGGAAGGTGGACAACGCCCTGCA GTCCGGCAACTCCCAGGAATCCGTGACCGAGCAGGACTCCAAGGACAGCACCTACTCC CTGTCCTCCACCCTGACCCTGTCCAAGGCCGACTACGAGAAGCACAAGGTGTACGCCT GCGAAGTGACCCACCAGGGCCTGTCTAGCCCCGTGACCAAGTCTTTCAACCGGGGCGA GTGT |
| 48 | NORI-007 | CDRH1 (IMGT) | Amino acid sequence of CDRH1 using IMGT | GFTFGDFG |
| 49 | NORI-007 | CDRH2 (IMGT) | Amino acid sequence of CDRH2 using IMGT | IRSKPYGGTT |
| 104 | NORI-007 | CDRH3 (IMGT) | Amino acid sequence of CDRH3 using IMGT | SRNDILTGYYIFDY |

-continued

| SEQ ID NO | | Description | Sequence |
|---|---|---|---|
| 51 | NORI-007 | Amino acid sequence of CDRH1 using Kabat | DFGMS |
| 105 | NORI-007 | Amino acid sequence of CDRH2 using Kabat | FIRSKPYGGTTDYAPSVKG |
| 106 | NORI-007 | Amino acid sequence of CDRH3 using Kabat | NDILTGYYIFDY |
| 107 | NORI-007 | Heavy chain variable region | EVQLVESGGGLVKPGRSLRLSCTGSGFTFGDFGMSWFRQAPGKGLEWVCFIRSKPYGG TTDYAPSVKGRFTISRDDSISIAYLQMNSLTTEDTAVYYCSRNDILTGYYIFDYWGQG TQVTVSS |
| 108 | NORI-007 | Nucleic acid sequence of VH | GAGGTGCAGTTGGTGGAATCTGGGGGAGGCTTGGTAAAACCAGGGCGGTCCCTGAGAC TCTCCTGTACAGGTTCTGGATTCACCTTTGGTGATTTGGTATGAGTTGGTTCCGCCA GGCTCCAGGGAAGGGCTGGAGTGGGTATGTTTCATTAGAAGCAAACCTTATGGTGGA ACAACAGATTATGCCCCGTCTGTGAAAGGCAGATTCACCATCTCAAGAGATGATTCA TAAGCATCGCCTATCTGCAAATGAATAGCCTGACAACCGAGGACACAGCCGTATATTA TTGTAGTCGAAACGATATTTTGACCGGTTATTATATCTTTGACTACTGGGGCCAGGGA ACCCAGGTCACCGTCTCCTCA |
| 109 | NORI-007 | Amino acid sequence heavy chain | EVQLVESGGGLVKPGRSLRLSCTGSGFTFGDFGMSWFRQAPGKGLEWVCFIRSKPYGG TTDYAPSVKGRFTISRDDSISIAYLQMNSLTTEDTAVYYCSRNDILTGYYIFDYWGQG TQVTVSSASTKGPSVFPLAPCSRSTSESTAALGCLVKDYFPEPVTVSMNSGALTSGVH TFPAVLQSSGLYSLSSVVTVPSSSLGTKTYTCNVDHKPSNTKVDKRVESKYGPPCPPC PAPEFEGGPSVFLFPPKPKDTLMISRTPEVTCVVVDVSQEDPEVQFNWYVDGVEVHNA KTKPREEQFNSTYRVVSVLTVLHQDWLNGKEYKCKVSNKGLPSSIEKTISKAKGQPRE PQVYTLPPSQEMTKNQVSLTCLVKGFYPSDIAVEWESNGQPENNYKTTPPVLDSDGS FFLYSRLTVDKSRWQEGNVFSCSVMHEALHNHYTQKSLSLSLGK |
| 110 | NORI-007 | Nucleic acid sequence heavy chain | GAGGTGCAGTTGGTGGAATCTGGGGGAGGCTTGGTAAAACCAGGGCGGTCCCTGAGAC TCTCCTGTACAGGTTCTGGATTCACCTTTGGTGATTTGGTATGAGTTGGTTCCGCCA GGCTCCAGGGAAGGGCTGGAGTGGGTATGTTTCATTAGAAGCAAACCTTATGGTGGA ACAACAGATTATGCCCCGTCTGTGAAAGGCAGATTCACCATCTCAAGAGATGATTCA TAAGCATCGCCTATCTGCAAATGAATAGCCTGACAACCGAGGACACAGCCGTATATTA TTGTAGTCGAAACGATATTTTGACCGGTTATTATATCTTTGACTACTGGGGCCAGGGA ACCCAGGTCACCGTCTCCTCAGCTTCCACCAAGGGCCCCTTGGCCC CTTGCGCAGGAGCACCTCCGAATCCACAGCTGCCCTGGGCTGTCTGGTGAAGGACTA CTTTCCCGAGCCCGTGACCGTGAGCTGGAACAGCGGCGCTCTACCTCCCTGTCCTCCGTGGTGACCG TGCCTAGCTCCTCCGCCGTCCTCCAGCACCTGCCTCCCTGTCCTCCCGTGGTGACCG CAACACCAAGGTGGACAAACGGGTGGAGAGCAAGTACGGCCCTCCCTGCCCTCCTTGT CCTGCCCCCGAGTTCGAAGGCCGGACACCCGAGGTGACCTGCGTGGTGGATGTGAGCCA ACACCCTGAGGTGCAGTTCAACTGGTATGTGGACGGCGTGGAGGTGCACAACGCC AAGACAAAGCCCGGGAAGAGCAGTTCAACTCCACCTACAGGGTGGTCAGCGTGCTGA CCGTGCTGCATCAGGACTGGCTGAACGGCAAGGAGTACAAGTGCAAGGTCAGCAATAA GGGACTGCCCAGCAGCATCGAGAAGACCATCTCCAAGGCTAAAGGCCAGCCCCGGGAA CCTCAGGTGTACACCCTGCCTCCCAGCCAGGAGGAGATGACCAAGAACCAGGTGAGCC TGACCTGCCTGGTGAAGGGATTCTACCCTTCCGACATCGCCGTGGAGTGGGAGTCCAA |

-continued

| SEQ ID NO | | Description | Sequence |
|---|---|---|---|
| | | | CGGCCAGCCCGAGAACAATTATAAGACCACCCTCCCGTCCTCGACAGCGACGGATCC TTCTTTCTGTACTCCAGGCTGACCGTGGATAAGTCCAGGTGGCAGGAAGGCAACGTGT TCAGCTGCTCCGTGATGCACGAGCCCCTGCACAATCACTACCACCCAGAAGTCCCTGAG CCTGTCCCTGGGAAAG |
| 111 | NORI-007 | Amino acid sequence of CDRL1 (IMGT) | QDITNY |
| 59 | NORI-007 | Amino acid sequence of CDRL2 (IMGT) | DAS |
| 60 | NORI-007 | Amino acid sequence of CDRL3 (IMGT) | QQYYNLPLT |
| 112 | NORI-007 | Amino acid sequence of CDRL1 (KABAT) | QASQDITNYLI |
| 113 | NORI-007 | Amino acid sequence of CDRL2 (KABAT) | DASNLET |
| 60 | NORI-007 | Amino acid sequence of CDRL3 (KABAT) | QQYYNLPLT |
| 114 | NORI-007 | Light chain variable region | DIQMTQSPSSLSASLGDSITITCQASQDITNYLIWYQHKPGKAPKLLIFDASNLETGV PSRFSGSGSGTDFTFTISSLQPEDYATYYCQQYYNLPLTFGGGTKVDIK |
| 115 | NORI-007 | Nucleic acid sequence of VL | GACATCCAGATGACCCAGTCTCCATCCTCCCTGTCTGCTTCTTTAGGAGACAGCATCA CCATCACTTGCCAGGCGAGTCAGGACATTACCAACTATTTAATTTGGTATCAGCATAA ACCGGGGAAAGCCCCTAAACTCCTTATCTTCGATGCATCCAATCCAATTTGGAAACAGGGGTC CCATCAAGGTTCAGTGGAAGTGGGTCTGGGACAGATTTCACTTTCACCATCAGCAGCC TGCAGCCTGAAGATTATGCAACGTATTACTGTCAGCAGTATTATAATCTCCCGCTCAC TTTCGGCGGAGGGACCAAGGTGGACATCAAA |
| 116 | NORI-007 | Full light chain sequence | DIQMTQSPSSLSASLGDSITITCQASQDITNYLIWYQHKPGKAPKLLIFDASNLETGV PSRFSGSGSGTDFTFTISSLQPEDYATYYCQQYYNLPLTFGGGTKVDIKRTVAAPSVF IFPPSDEQLKSGTASVVCLLNNFYPREAKVQWKVDNALQSGNSQESVTEQDSKDSTYS LSSTLTLSKADYEKHKVYACEVTHQGLSSPVTKSFNRGEC |
| 117 | NORI-007 | Nucleic acid sequence Full light chain sequence | GACATCCAGATGACCCAGTCTCCATCCTCCCTGTCTGCTTCTTTAGGAGACAGCATCA CCATCACTTGCCAGGCGAGTCAGGACATTACCAACTATTTAATTTGGTATCAGCATAA ACCGGGGAAAGCCCCTAAACTCCTTATCTTCGATGCATCCAATCCAATTTGGAAACAGGGGTC CCATCAAGGTTCAGTGGAAGTGGGTCTGGGACAGATTTCACTTTCACCATCAGCAGCC TGCAGCCTGAAGATTATGCAACGTATTACTGTCAGCAGTATTATAATCTCCCGCTCAC TTTCGGCGGAGGGACCAAGGTGGACATCAAACGTACGGTGGCCGCTCCCTCCGTGTTC ATCTTCCCACCTTCCGACGAGCAGCTGAAGTCCGGCACCGCTTCTGTGTGCCTGC TGAACAACTTCTACCCCCGAGAATCCGTGACCGAGCAGGACTCCAAGGACAGCACCTACTCC GTCCGGCAACTCCGGAGAATCCGTGACCGAGCAGGACTCCAAGGACAGCACCTACTCC |

-continued

| SEQ ID NO | | | Description | Sequence |
|---|---|---|---|---|
| | | | | CTGTCCTCCACCCTGACCCTGTCCAAGGCCCGACTACGAGAAGCACAAGGTGTACGCCTGCGAAGTGACCCACCAGGCGGCTGTCTAGCCCCGTGACCAAGTCTTTCAACCGGGGCGAGTGT |
| 118 | NORI-008 | CDRH1 (IMGT) | Amino acid sequence of CDRH1 using IMGT | GGSVSGRYY |
| 119 | NORI-008 | CDRH2 (IMGT) | Amino acid sequence of CDRH2 using IMGT | ISNSGNT |
| 120 | NORI-008 | CDRH3 (IMGT) | Amino acid sequence of CDRH3 using IMGT | ARGFIYDYWFDP |
| 121 | NORI-008 | CDRH1 (KABAT) | Amino acid sequence of CDRH1 using Kabat | SGRYYWT |
| 122 | NORI-008 | CDRH2 (KABAT) | Amino acid sequence of CDRH2 using Kabat | YISNSGNTNYNPSLKS |
| 123 | NORI-008 | CDRH3 (KABAT) | Amino acid sequence of CDRH3 using Kabat | GFIYDYWFDP |
| 124 | NORI-008 | Heavy chain variable region | Amino acid sequence of VH | QVQLQESGPGLVKPSETLSLTCSVSGGSVSSGRYYWTWIRQPPGKGLEWIGYISNSGNTNYNPSLKSRVTISLDTSKKQFSLSLSAVTAADTAVYYCARGFIYDYWFDPWGQGSLVTVSS |
| 125 | NORI-008 | Heavy chain variable region | Nucleic acid sequence of VH | CAGGTGCAGCTGCAGGAGTCGGGCCCAGGACTGGTAAAGCCTTCGGAGACCCTGTCCCTCACATGTAGTGTTCTGGTGGCTCCGTCAGTGGTCGTTACTATTGGACCTGGATCCGGCAGCCCCCAGGGAAGGGACTGGAGTGGATTGGATATATATCTAATAGTGGGAACACCAACTACACACCCTCCCTCAAGAGCCGAGTCACCATATCCTTGACACGTCCAAGAAACAGTTCTCCCTGAGCCTGAGTGCTGTGACCGCTGCGACACGGCCGTATATTACTGTGCGCGAGGATTCATCTATGATTACTGGTTCGACCCCTGGGGCCAGGGAAGCCTGGTCACCGTCTCCTCA |
| 126 | NORI-008 | Full heavy chain sequence | Amino acid sequence heavy chain | QVQLQESGPGLVKPSETLSLTCSVSGGSVSSGRYYWTWIRQPPGKGLEWIGYISNSGNTNYNPSLKSRVTISLDTSKKQFSLSLSAVTAADTAVYYCARGFIYDYWFDPWGQGSLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK |
| 127 | NORI-008 | Full heavy chain sequence | Nucleic acid sequence heavy chain | CAGGTGCAGCTGCAGGAGTCGGGCCCAGGACTGGTAAAGCCTTCGGAGACCCTGTCCCTCACATGTAGTGTTCTGGTGGCTCCGTCAGTGGTCGTTACTATTGGACCTGGATCCGGCAGCCCCCAGGGAAGGGACTGGAGTGGATTGGATATATATCTAATAGTGGGAACACCAACTACACACCCTCCCTCAAGAGCCGAGTCACCATATCCTTGACACGTCCAAGAAACAGTTCTCCCTGAGCCTGAGTGCTGTGACCGCTGCGACACGGCCGTATATTACTGTGCGCGAGGATTCATCTATGATTACTGGTTCGACCCCTGGGGCCAGGGAAGCCTGGTCACCGTCTCCTCAGCCAGCACCAAGGGCCCCTCCGTGTTCCCCCTGGCCCCTTGCAGCA |

-continued

| SEQ ID NO | | Description | Sequence |
|---|---|---|---|
| | | | GGAGCACCTCCGAATCCACAGCTGCCCTGGCGTGTCTGGTGAAGGACTACTTTCCCGA<br>GCCCGTGACCGTGAGCTGGAACAGCGGCGTCTCGACATCCGGCGTCCACACCTTTCCT<br>GCCGTCCTGCAGTCCTCCGGCCTCTACTCCCTGTCCTCCGTGGTGACCGTGCCTAGCT<br>CCTCCCTGGGCACCCAGACCTACACCTGTAACGTGGACCACAAACCCTCCAACACCAA<br>GGTGGACAAACGGGTCGAGAGCAAGTACGGCCCTCCCTGCCCTCCTTGTCCTGCCCCC<br>GAGTTCGAAGGCGGACCCAGCGTGTTCCTGTTCCCTCCTAAGCCCAAGGACACCCTCA<br>TGATCAGCCGGACCACCGAGGTGACCTGCGTGGTGGTGGATGTGAGCCAGGAGGACCC<br>TGAGGTCCAGTTCAACTGGTATGTGGATGGCGTGGAGGTGCACAACGCCAAGACAAAG<br>CCCCGGGAAGAGCAGTTCAACTCCACCTACAGGGTGGTCAGCGTGCTGACCGTGCTGC<br>ATCAGGACTGGCTGAACGGCAAGGAGTACAAGTGCAAGGTCAGCAATAAGGGACTGCC<br>CAGCAGCATCGAGAAGACCATCTCCAAGGCTAAAGGCCAGCCCCGGGAACCTCAGGTG<br>TACACCCTGCCCCCTAGCCAGGAGGAGATGACCAAGAACCAGGTGAGCCTGACCTGCC<br>TGGTGAAGGGATTCTACCCTTCCGACATCGCCGTGGAGTGGGAGTCCAACGGCCAGCC<br>CGAGAACAATTATAAGACCACCCCTCCCGTCCTGGACAGCGACGGATCCTTCTTTCTG<br>TACTCCAGGCTGACCGTGGATAAGTCCAGGTGGCAGGAAGGCAACGTGTTCAGCTGCT<br>CCGTGATGCACGAGGCCCTGCACAATCACTACACCCAGAAGTCCCTGAGCCTGTCCCT<br>GGGAAAG |
| 128 | NORI-008 | CDRL1 (IMGT) | Amino acid sequence of CDRL1 using IMGT | QDIDNY |
| 59 | NORI-008 | CDRL2 (IMGT) | Amino acid sequence of CDRL2 using IMGT | DAS |
| 129 | NORI-008 | CDRL3 (IMGT) | Amino acid sequence of CDRL3 using IMGT | QQYGNLPIT |
| 130 | NORI-008 | CDRL1 (KABAT) | Amino acid sequence of CDRL1 using KABAT | QASQDIDNYLN |
| 131 | NORI-008 | CDRL2 (KABAT) | Amino acid sequence of CDRL2 using KABAT | DASKLET |
| 129 | NORI-008 | CDRL3 (KABAT) | Amino acid sequence of CDRL3 using KABAT | QQYGNLPIT |
| 132 | NORI-008 | Light chain variable region | Amino acid sequence of VL | DSQMTQSPSSLSASVGDRVTITCQASQDIDNYLNWYQQRPGKAPKLLIYDASKLETGV<br>PSRFSGSGSGTDFTFTISSLQPEDFATYYCQQYGNLPITFGQGTRLDIK |
| 133 | NORI-008 | Light chain variable region | Nucleic acid sequence of VL | GACAGCCAGATGACCCAGTCTCCATCCTCCCTGTCTGCTTCTGTAGGAGACAGAGTCA<br>CCATCACTTGCCAGGCCAGTCAGGACATTGACAACTATTTAAATTGGTATCAGCAGAG<br>ACCAGGGAAAGCCCCTAAACTCCTGATCTACGATGCATCCAAGTTGGAAACGGGGGTC<br>CCATCAAGGTTCAGTGGAAGTGGATCTGGGACAGATTTTACTTTCACCATCAGCAGCC<br>TGCAACCTGAAGATTTTGCAACATATTACTGTCAACAATATGGTAATCTCCCGATCAC<br>CTTCGGCCAAGGGACCACGACTGGACATTAAA |

-continued

| SEQ ID NO | | Description | Sequence |
|---|---|---|---|
| 134 | NORI-008 | Full light chain sequence | Amino acid sequence light chain | DSQMTQSPSSLSASVGDRVTITCQASQDIDNYLNWYQQRPGKAPKLLIYDASKLETGV PSRFSGSGSGTDFTFTISSLQPEDFATYYCQQYGNLPITFGQGTRLDIKRTVAAPSVF IFPPSDEQLKSGTASVVCLLNNFYPREAKVQWKVDNALQSGNSQESVTEQDSKDSTYS LSSTLTLSKADYEKHKVYACEVTHQGLSSPVTKSFNRGEC |
| 135 | NORI-008 | Full light chain sequence | Nucleic acid sequence light chain | GACAGCCAGATGACCCAGTCTCCATCCTCCCTGTCTGCTTCTGTAGGAGACAGAGTCA CCATCACTTGCCAGGCGAGTCAGGACATTGACAACTATTTAAATTGGTATCAGCAGAG ACCAGGGAAAGCCCCTAAACTCCTGATCTACGATGCATCCAAGTTGGAAACGGGGGTC CCATCAAGGTTCAGTGGAAGTGGATCTGGGACAGATTTTACTTTCACCATCAGCAGCC TGCAACCTGAAGATTTTGCAACATATTCGTCAACAATATGGTAATCTCCCGATCAC CTTCGGCCAAGGACACGACTGGACATTAAACGTACGGTGGCCGCTCCTTCGTGTGTTC ATCTTCCCACCTTCCGACGAGCAGTTGAAGTCCGGCAACTGCTTCTGTGTGCCTGC TGAACAACTTCTACCCCGCGAGGCCAAGGTGCAGTGGAAGGTGGACAACGCCCTGCA GTCCGGCAACTCCCAGGAATCCGTGACCGAGCAGGACTCCAAGGACAGCACCTACTCC CTGTCCTCCACCCTGACCCTGTCCAAGGCCGACTACGAGAAGCACAAGGTGTACGCCT GCGAAGTGACCCACCAGGGCCTGTCTAGCCCCGTGACCAAGTCTTTCAACCGGGGCGA GTGT |
| 136 | NORI-009 | | Amino acid sequence of CDRH1 using IMGT | GFTFNDHV |
| 137 | NORI-009 | | Amino acid sequence of CDRH2 using IMGT | ISWNSDTI |
| 138 | NORI-009 | | Amino acid sequence of CDRH3 using IMGT | AREKDGDFYDYFAMDV |
| 139 | NORI-009 | | Amino acid sequence of CDRH1 using Kabat | DHVIY |
| 140 | NORI-009 | | Amino acid sequence of CDRH2 using Kabat | TISWNSDTIAYADSVKG |
| 141 | NORI-009 | | Amino acid sequence of CDRH3 using Kabat | EKDGDFYDYFAMDV |
| 142 | NORI-009 | Heavy chain variable region | Amino acid sequence of VH | EVQLVESGGGLVQPGRSLRLSCAASGFTFNDHVIYWVRQVPGKGLEWVSTISWNSDTI AYADSVKGRFTISRDNAKNALYLQMNSLRTEDTALYYCAREKDGDFYDYFAMDVWGQ GTTVTVSS |
| 143 | NORI-009 | Heavy chain variable region | Nucleic acid sequence of VH | GAAGTGCAGTTGGTGGAGTCTGGGGGAGGCTTGGTTCAGCCTGGCAGGTCCCTGAGAC TCTCCTGTGCAGCCTCTGGATTCACCTTTAATGATCATGTCATATATTGGGTCCGACA AGTTCCAGGAAAGGGCCTGGAGTGGGTCTCAACTATTAGTTGGAATAGTGATACCATT GCCTATGCGGACTCTGTGAAGGGCCGATTCACCATCTCCAGAGACAACGCCAAGAACG CCCTATATCTGCAAATGAATAGTCTGAGAACTGAAGACACGGCCTTGTATTACTGTGC AAGAGAAAAGACGGTGACTTTTACTATGACTACTTCGCTATGGACGTCTGGGGCCAA GGGACCACGGTCACCGTCTCCTCA |

-continued

| SEQ ID NO | | Description | Sequence |
|---|---|---|---|
| 144 | NORI-009 | Full heavy chain sequence | Amino acid sequence heavy chain | EVQLVESGGGLVQPGRSLRLSCAASGFTFNDHVIYWVRQVPGKGLEWVSTISWNSDTI AYADSVKGRFTISRDNAKNALYLQMNSLRIEDTALYYCAREKGDFYDYFAMDVWGQ GTTVTVSSASTKGPSVFPLAPCSRSTSESTAALGCLVKDYFPEPVTVSWNSGALTSGV HTFPAVLQSSGLYSLSSVVTVPSSSLGTKTYTCNVDHKPSNTKVDKRVESKYGPPCPP CPAPEFEGGPSVFLFPPKPKDTLMISRTPEVTCVVVDVSQEDPEVQFNWYVDGVEVHN AKTKPREEQFNSTYRVVSVLTVLHQDWLNGKEYKCKVSNKGLPSSIEKTISKAKGQPR EPQVYTLPPSQEEMTKNQVSLTCLVKGFYPSDIAVEWESNGQPENNYKTTPPVLDSDG SFFLYSRLTVDKSRWQEGNVFSCSVMHEALHNHYTQKSLSLSLGK |
| 145 | NORI-009 | Full heavy chain sequence | Nucleic acid sequence heavy chain | GAAGTGCAGTTGGTGGAGTCTGGGGGAGGCTTGGTTCAGCCTGGCCAGTCCCTGAGAC TCTCCTGTGCAGCCTCTGGATTCACCTTTAATGATCATGTCATATATTGGGTCCGACA AGTTCCAGGAAAGGGCCTGGAGTGGGTCTCAACTATTAGTTGGAATAGTGATACCATT GCCTATGCCGACTCTGTGAAGGGCCGATTCACCATCTCCAGAGACAACGCCAAGAACG CCCTATATCTGCAAATGAATAGTCTGAGAACTGAAGACACTGCCTTGTATTACTGTGC AAGAGAAAAAGACGGTGACTTTTACTATGACTACTTCGCTATGGACGTCTGGGGCCAA GGGACCACGGTCACCGTCTCCTCAGCCAGCACCAAGGGCCCCTCCGTGTTCCCCCTGG CCCCTTGCAGCAGGAGCACCTCGGAATCCACAGCTGCCCTGGGCTGCCTGGTCAAGGA CTACTTTCCCGAGCCCGTGACCGTGAGCTGGAACAGCGGCGCCCTGACATCCGGCGTC CACACCTTTCCTGCCGTCCTGCAGTCCTCCGGCCTCTACTCCCTGTCCTCCGTGGTGA CCGTGCCTAGCTCCTCCTCCGGCACCAAGACCTACACCTGTAACGTGGACCACAAACC CTCCAACACCAAGGTGGACAAAGGGGTGGAGCAAGTACGGCCCCCCTGCCCTCCCT TGTCCTGCCCCAGTTCGAAGGCGGACACCCGAGGTGACCTGCGTGGTGGTGGATGTGAG AGGACACCCCATGATCAGCCGGACCCAGTTCAACTGGTATGTGGACGGCGTGCACAAC GCCAAGACAAAGCCCGGAGAGAGCAGTTCAACTCCACCTACAGGGTGGTCAGCGTGC TGACCGTGCTGCTCAGCAGCATCGAGAGACCATCTCAAGGCAAGAGAGTACAAGGTCAGCAA TAAGGGACTGCCCAGCAGCATCGAGAAAACGATCTCCAAGGCTAAAGGCCAGCCCCGG GAACCTCAGGTGTACACCCTGCCTCCCTCCCAGCCAGGAGGAGATGACCAAGAACCAGGTGA GCCTGACCTGCCTGGTGAAGGGATTCTACCCTTCCGACATTGCCGTCGAATGGGAGAGTC AACGGCCAGCCCGAGAACAATTATAAGACCACCCCTCCCGTGCTGGACTCCGACGGCA TCCTTCTTTCTGTACTCCAGGCTGACCGTGGACAAGAGTCCAGGTGGCCAGGAAGGCAACG TGTTCAGCTGCTCCGTGATGCACGAGGCCCTGCACAATCACTACACCCAGAAGTCCCT GAGCCTGTCCCTGGGAAAG |
| 146 | NORI-009 | Amino acid sequence of CDRL1 (IMGT) | | SSDVGYYNY |
| 147 | NORI-009 | Amino acid sequence of CDRL2 (IMGT) | | EVS |
| 148 | NORI-009 | Amino acid sequence of CDRL3 (IMGT) | | SSYAGSNKW |
| 149 | NORI-009 | Amino acid sequence of CDRL1 using KABAT | | TGTSSDVGYYNYVS |
| 150 | NORI-009 | Amino acid sequence of CDRL2 using KABAT | | EVSKRPS |

-continued

| SEQ ID NO | | Description | Sequence |
|---|---|---|---|
| 148 | NORI-009 | CDRL3 (KABAT) | Amino acid sequence of CDRL3 using KABAT | SSYAGSNKW |
| 151 | NORI-009 | Light chain variable region | Amino acid sequence of VL | QSALTQPPSASGSPGQSVTLSCTGTSSDVGYYNYVSWYLQHPGKAPKLMIYEVSKRPS GVPDRFSGSKSANTASLTVSGLQAEDEADYCSSYAGSNKVVFGGGTKVTVL |
| 152 | NORI-009 | Light chain variable region | Nucleic acid sequence of VL | CAGTCTGCCCTGACTCAGCCTCCCTCCGCGTCCGGGTCTCCTGGACAGTCAGTCACCC TCTCCTGCACTGGAACCAGTAGTGACGTTGGTTATTATAACTATGTCTCCTGGTACCT ACAGCACCCAGGCAAAGCCCCCAAACTCATGATTTATGAGGTCAGTAAGCGGCCCTCA GGGGTCCCTGATCGCTTTTCTGGCTCCAAGTCTGCCAACACGGCCTCCCTGACCGTCT CTGGGCTCCAGGCTGAGGATGAGGCTGATTATTATTGCAGCTCAATATGCAGGCAGCAA CAAAGTGGTATTCGGCGGAGGGACCAAGGTGACCGTCCTA |
| 153 | NORI-009 | Full light chain sequence | Amino acid sequence light chain | QSALTQPPSASGSPGQSVTLSCTGTSSDVGYYNYVSWYLQHPGKAPKLMIYEVSKRPS GVPDRFSGSKSANTASLTVSGLQAEDEADYCSSYAGSNKVVFGGGTKVTVLGQPKAA PSVTLFPPSSEELQANKATLVCLISDFYPGAVTVAWKADSSPVKAGVETTTPSKQSNN KYAASSYLSLTPEQWKSHRSYSCQVTHEGSTVEKTVAPTECS |
| 154 | NORI-009 | Full light chain sequence | Nucleic acid sequence light chain | CAGTCTGCCCTGACTCAGCCTCCCTCCGCGTCCGGGTCTCCTGGACAGTCAGTCACCC TCTCCTGCACTGGAACCAGTAGTGACGTTGGTTATTATAACTATGTCTCCTGGTACCT ACAGCACCCAGGCAAAGCCCCCAAACTCATGATTTATGAGGTCAGTAAGCGGCCCTCA GGGGTCCCTGATCGCTTTTCTGGCTCCAAGTCTGCCAACACGGCCTCCCTGACCGTCT CTGGGCTCCAGGCTGAGGATGAGGCTGATTATTATTGCAGCTCAATATGCAGGCAGCAA CAAAGTGGTATTCGGCGGAGGGACCAAGGTGACCGTCCTAGGACAGCCCAAAGCAGCC CCATCCGTAACTCTGTTCCCACCTAGTTCAGAGGAGCTTCAAGCAAACAAAGCCACAC TTGTTTGCCTTATTAGTGATTTTATCCCGGTGCCGTGACAGTTGCCTGGAAAGTGA AGTATGTGCCAGCTCATATGTGACTGTAGCTCCACTCCAGAACAATGGAAGTCTCATCGGT CCTATAGCTGTCAAGTGACCCCACGAGGCAGTACCGTCGAGAAGACCGTGCACCAAC AGAGTGTAGC |
| 155 | NORI-010 | CDRH1 (IMGT) | Amino acid sequence of CDRH1 using IMGT | GFTFDDHV |
| 137 | NORI-010 | CDRH2 (IMGT) | Amino acid sequence of CDRH2 using IMGT | ISWNSDTI |
| 156 | NORI-010 | CDRH3 (IMGT) | Amino acid sequence of CDRH3 using IMGT | AREKDGDFYYNYFVMDV |
| 157 | NORI-010 | CDRH1 (KABAT) | Amino acid sequence of CDRH1 using Kabat | DHVMY |
| 158 | NORI-010 | CDRH2 (KABAT) | Amino acid sequence of CDRH2 using Kabat | GISWNSDTIGYADAVKG |
| 159 | NORI-010 | CDRH3 (KABAT) | Amino acid sequence of CDRH3 using Kabat | EKDGDFYYNYFVMDV |

-continued

| SEQ ID NO | | Description | Sequence |
|---|---|---|---|
| 160 | NORI-010 | Heavy chain variable region | Amino acid sequence of VH | EVQLVESGGGLVQPGRSLRLSCAASGFTFDDHVMYWVRQGPKGLEWVSGISWNSDTI GYADAVKGRFTISRDNAKNVLYLQMNSLRPEDTALYYCAREKDGDFYNYFVMDVWGQ GTTVTVSP |
| 161 | NORI-010 | Heavy chain variable region | Nucleic acid sequence of VH | GAAGTGCAGTTGGTGGAGTCTGGGGGAGGCTTGGTACAGCCTGGCAGTCCCTGAGAC TCTCCTGTGCAGCCTCTGGATTCACCTTTGATGATCATGTCATGTATTGGGTCCGGCA AGGTCCAGGGAAGGGCCTGGAGTGGGTCTCAGGTATTAGTTGGAATAGTGATACCATT GGCTATGCGGACGCGTGAAGGGCCGATTCACCATCTCCAGAGACAACGCCAAGAACG TCCTATATCTGCAAATGAACAGTCTGAGACCTGAGGACACGGCCTTGTATTACTGTGC AAGAGAAAGACGGTGACTTTTACTATAACTACTTCGTTATGGACGTCTGGGGCCAA GGGACCACGGTCACCGTCTCCCCA |
| 162 | NORI-010 | Full heavy chain sequence | Amino acid sequence heavy chain | EVQLVESGGGLVQPGRSLRLSCAASGFTFDDHVMYWVRQGPKGLEWVSGISWNSDTI GYADAVKGRFTISRDNAKNVLYLQMNSLRPEDTALYYCAREKDGDFYNYFVMDVWGQ GTTVTVSPASTKGPSVFPLAPCSRSTSESTAALGCLVKDYFPEPVTVSWNSGALTSGV HTFPAVLQSSGLYSLSSVVTVPSSSLGTKTYTCNVDHKPSNTKVDKRVESKYGPPCPP CPAPEFEGGPSVFLFPPKPKDTLMISRTPEVTCVVVDVSQEDPEVQFNWYVDGVEVHN AKTKPREEQFNSTYRVVSVLTVLHQDWLNGKEYKCKVSNKGLPSSIEKTISKAKGQPR EPQVYTLPPSQEEMTKNQVSLTCLVKGFYPSDIAVEWESNGQPENNYKTTPPVLDSDG SFFLYSRLTVDKSRWQEGNVFSCSVMHEALHNHYTQKSLSLSLGK |
| 163 | NORI-010 | Full heavy chain sequence | Nucleic acid sequence heavy chain | GAAGTGCAGTTGGTGGAGTCTGGGGGAGGCTTGGTACAGCCTGGCAGTCCCTGAGAC TCTCCTGTGCAGCCTCTGGATTCACCTTTGATGATCATGTCATGTATTGGGTCCGGCA AGGTCCAGGGAAGGGCCTGGAGTGGGTCTCAGGTATTAGTTGGAATAGTGATACCATT GGCTATGCGGACGCGTGAAGGGCCGATTCACCATCTCCAGAGACAACGCCAAGAACG TCCTATATCTGCAAATGAACAGTCTGAGACCTGAGGACACGGCCTTGTATTACTGTGC AAGAGAAAGACGGTGACTTTTACTATAACTACTTCGTTATGGACGTCTGGGGCCAA GGGACCACGGTCACCGTCTCCTCAGCCTCCACCAAGGGCCCATCGGTCTTCCCCCTGG CCCCTTGCAGCGAGCACCTCCGAATCCACAGCTGCCCTGGGCTGCCTGGTCAAGGACT ACTTCCCCGAGCCCGTGACCGTGAGCTGGAACAGCGGCGCCCTGACCAGCGGCGTC CACACCTTTCCTGCCGTGCTGCAGTCCTCCGGCCTCTACTCCCTGTCCTCCGTGGTGA CCGTGCCTAGCTCCTCCTCCGGCACCAAGACCTACACCTGTAACGTGGACCACAAACC CTCCAACACCAAGGTGGACAAGCGGGTCGAGAGCAAGTACGGCCCTCCCTGCCCTCCT TGTCCTGCCCCCCAGTCGAAGGCGGACCCAGCGTGTTCCTGTTCCCTCCTAAGCCCA AGGACACCCTCATGATCAGCCGGACACCCGAGGTGACCTGCGTGGTGGTGGATGTGAG CCAGGAGGACCCTGAGGTCCAGTTCAACTGGTATGTGGACGGCGTGGAGGTGCACAAC GCCAAGACAAAGCCCCGGGAAGAGCAGTTCAACTCCACCTACAGGGTGGTCAGCGTGC TGACCGTGCTGCATCAGGACTGGCTGAACGGCAAGGAGTACAAGTGCAAGGTCAGCAA TAAGGGACTGCCCAGCAGCATCGAGAAGACCATCTCCAAGGCTAAAGGCCAGCCCCGG GAACCTCAGGTGTACACCCTGCCTCCCAGCCAGGAGGAGATGACCAAGAACCAGGTGA CAACGGCCAGCCCGAGAACAATTATAAGACCACCCCTCCCGTGCTGGACAGCGACGGA TCCTTCTTTCTGTACTCCAGGCTGACCGTGGATAAGTCCAGTGGCAGGAAGGCAACG TGTTCAGCTGCTCCGTGATGCACGAGGCCCTGCACAATCACTACACCCAGAAGTCCCT GAGCCTGTCCCTGGGAAAG |
| 164 | NORI-010 | CDRL1 (IMGT) | Amino acid sequence of CDRL1 using IMGT | SSDVGFYNF |

-continued

| SEQ ID NO | | Description | Sequence |
|---|---|---|---|
| 147 | NORI-010 | Amino acid sequence of CDRL2 (IMGT) | EVS |
| 148 | NORI-010 | Amino acid sequence of CDRL3 (IMGT) | SSYAGSNKW |
| 165 | NORI-010 | Amino acid sequence of CDRL1 (KABAT) | TGTSSDVGFYNFVS |
| 150 | NORI-010 | Amino acid sequence of CDRL2 (KABAT) | EVSKRPS |
| 148 | NORI-010 | Amino acid sequence of CDRL3 (KABAT) | SSYAGSNKW |
| 166 | NORI-010 | Light chain variable region | QSALTQPPSASGSPGQSVTISCTGTSSDVGFYNFVSWYQQHPDKAPKVMIYEVSKRPS GVPDRFSGSKSGNTASLTVSGLQAEDEADYYCSSYAGSNKWFGGGTKLTVL |
| 167 | NORI-010 | Nucleic acid sequence of VL | CAGTCTGCCCTGACTCAGCCTCCCTCCGCGTCCGGGTCTCCTGGACAGTCAGTCACCA TCTCCTGCACTGGAACCAGCAGTGACGTTGGTTTTATAACTTTGTCTCCTGGTACCA ACAGCACCCAGACAAAGCCCCCAAAGTCATGATTTATGAGGTCAGTAAGCGGCCCTCA GGGGTCCCTGATCGCTTCTCTGGCTCCAAGTCTGGCAACACGGCCTCCCTGACCGTCT CTGGGCTCCAGGCTGAGGATGAGGCTGACTATTACTGCAGCTCATATGCAGGCAGCAA CAAAGTGGTTTTCGGCGGAGGGACCAAGTTGACCGTCCTA |
| 168 | NORI-010 | Amino acid sequence light chain | QSALTQPPSASGSPGQSVTISCTGTSSDVGFYNFVSWYQQHPDKAPKVMIYEVSKRPS GVPDRFSGSKSGNTASLTVSGLQAEDEADYYCSSYAGSNKVVFGGGTKLTVLGQPKAA PSVTLFPPSSEELQANKATLVCLISDFYPGAVTVAWKADSSPVKAGVETTTPSKQSNN KYAASSYLSLTPEQWKSHRSYSCQVTHEGSTVEKTVAPTECS |
| 169 | NORI-010 | Nucleic acid sequence light chain | CAGTCTGCCCTGACTCAGCCTCCCTCCGCGTCCGGGTCTCCTGGACAGTCAGTCACCA TCTCCTGCACTGGAACCAGCAGTGACGTTGGTTTTATAACTTTGTCTCCTGGTACCA ACAGCACCCAGACAAAGCCCCCAAAGTCATGATTTATGAGGTCAGTAAGCGGCCCTCA GGGGTCCCTGATCGCTTCTCTGGCTCCAAGTCTGGCAACACGGCCTCCCTGACCGTCT CTGGGCTCCAGGCTGAGGATGAGGCTGACTATTACTGCAGCTCATATGCAGGCAGCAA CCATCCGTAACTCTGTTCCCACCTAGTTCAGAGGAGCTTCAAGCAAACAAAGCCACAC TTGTTTGCCTTATTAGTGATTTTTATCCCGGTGCCGTGACAGTTGCCTGGAAGGCTGA TAGCTCACCAGTGAAAGCTGGCGTGGAGACAACCACCACCATCTAAACAAAGCAATAAC AGTATGGTGCCAGCTCATATGTGAGTCCACTCCAGAACAATGGAAGTCTCATCGGT CCTATAGCTGTCAAGTGACCCACGAAGGCAGTACCGTGGAGAAGACCGTGGCACCAAC AGAGTGTAGC |
| 155 | NORI-011 | Amino acid sequence of CDRH1 (IMGT) | GFTFDDHV |
| 137 | NORI-011 | Amino acid sequence of CDRH2 (IMGT) | ISWNSDTI |

-continued

| SEQ ID NO | | Description | Sequence |
|---|---|---|---|
| 156 | NORI-011 | CDRH3 (IMGT) | AREKDGDFYNYFVMDV |
| 157 | NORI-011 | CDRH1 (KABAT) | DHVMY |
| 158 | NORI-011 | CDRH2 (KABAT) | GISWNSDTIGYADAVKG |
| 159 | NORI-011 | CDRH3 (KABAT) | EKDGDFYNYFVMDV |
| 170 | NORI-011 | Heavy chain variable region | EVQLVESGGGLVQPGRSLRLSCAASGFTFDDHVMYWVRQGPGKGLEWVSGISWNSDTI GYADAVKGRFTISRDNAKNVLYLQMNSLRPEDTALYYCAREKDGDFYNYFVMDVWGQ GTTVTVSS |
| 171 | NORI-011 | Heavy chain variable region | Nucleic acid sequence of VH<br>GAAGTCGAGTTGGTGGAGTCTGGGGGAGGCTTGGTACAGCCTGGCAGGTCCCTGAGAC TCTCCTGTGCAGCCTCTGGATTCACCTTTGATGATCATGTCATGTATTGGGTCCGGCA AGGTCCAGGGAAGGGCCTGGAGTGGGTCTCAGGTATTAGTTGGAATAGTGATACCATT GGCTATGCGGACGCTGTGAAGGGCCGATTCACCATCTCCAGAGACAACGCCAAGAACG TCCTATATCTGCAAATGAACAGTCTGAGACCTGAGGACACGGCCCTTGTATTACTGTGC AAGAGAAAAGACGGTGACTTTTACTATAACTACTTCGTTATGGACGTCTGGGGCCAA GGGACCACGGTCACCGTCTCCTCA |
| 172 | NORI-011 | Full heavy chain sequence | Amino acid sequence heavy chain<br>EVQLVESGGGLVQPGRSLRLSCAASGFTFDDHVMYWVRQGPGKGLEWVSGISWNSDTI GYADAVKGRFTISRDNAKNVLYLQMNSLRPEDTALYYCAREKDGDFYNYFVMDVWGQ GTTVTVSSASTKGPSVFPLAPCSRSTSESTAALGCLVKDYFPEPVTVSWNSGALTSGV HTFPAVLQSSGLYSLSSVVTVPSSSLGTKTYTCNVDHKPSNTKVDKRVESKYGPPCPP CPAPEFEGGPSVFLFPPKPKDTLMISRTPEVTCVVVDVSQEDPEVQFNWYVDGVEVHN AKTKPREEQFNSTYRVVSVLTVLHQDWLNGKEYKCKVSNKGLPSSIEKTISKAKGQPR EPQVTTLPPSQEEMTKNQVSLTCLVKGFYPSDIAVEWESNGQPENNYKTTPPVLDSDG SFFLYSRLTVDKSRWQEGNVFSCSVMHEALHNHYTQKSLSLSLGK |
| 173 | NORI-011 | Full heavy chain sequence | Nucleic acid sequence heavy chain<br>GAAGTCGAGTTGGTGGAGTCTGGGGGAGGCTTGGTACAGCCTGGCAGGTCCCTGAGAC TCTCCTGTGCAGCCTCTGGATTCACCTTTGATGATCATGTCATGTATTGGGTCCGGCA AGGTCCAGGGAAGGGCCTGGAGTGGGTCTCAGGTATTAGTTGGAATAGTGATACCATT GGCTATGCGGACGCTGTGAAGGGCCGATTCACCATCTCCAGAGACAACGCCAAGAACG TCCTATATCTGCAAATGAACAGTCTGAGACCTGAGGACACGGCCCTTGTATTACTGTGC AAGAGAAAAGACGGTGACTTTTACTATAACTACTTCGTTATGGACGTCTGGGGCCAA GGGACCACGGTCACCGTCTCCTCAGGGGCCCTTCCGTGTTCCCCCTGG CCCCTTGCCAGCAGGACCACTTCCGAATCCCAGCTGCCCTGGGCTGTGCGTGAAGGA CTACTTTCCCGAGCCCGTGACCGTGTCCTGGAACTCTGGGGCTCTGACAACGCGGCGTC CACACCTTTCCTGCCGTCCTCCTGCCAGTCCTCCGGCCTCTACTCCCTGTCCTCCGGTGA CCGTGCCTAGCTCCTCCTGCCACCAAGACCTACACCTGTAACGTGGACCACAAACC CTCCAACACCAAGGTGGACAAGCGGGTCGAGAGCAAGTACGGCCCTCCCTGCCCTCCT TGTCCTGCCCCGAGTTGAAGGCGACCCCAGCCGTGTTCCTCCCTCCTAAGCCCA AGGACACCCTCATGATCAGCCGGACACCCGAGGTGACCTGCGTGGTGGTGGATGTGAG CCAGGAGGACCCCGAGGTGCAGTTCAACTGGTATGTGGATGGCGTGGAGGTGCACAAC GCCAAGACAAAGCCCCGGGAGGAGCAGTTCAACTCCACCTACAGGGTGGTCAGCGTGC TGACCGTGCTGCATCAGGACTGGCTGAACGGCAAGGAGTACAAGTGCAAGGTCAGCAA |

-continued

| SEQ ID NO | | Description | | Sequence |
|---|---|---|---|---|
| 164 | NORI-011 | | | TAAGGGACTGCCAGCAGCATCGAGAGAGACCATCTCCAAGGCTAAAGGCCAGCCCGG |
| | | | | GAACCTCAGTGTACACCGTGCCTCCAGCGAGGAGGATGACCAAGAACCAGTGA |
| | | | | GCCTGACCTGCCTGGTGAAGGGATTCTACCCTTCCGACATCGCCGTGGAGTGGGAGTC |
| | | | | CAACGGCCAGCCCGAGAACAATTATAGAGACCACCCTCCCTCCGTGCTGGACAGCGACGGA |
| | | | | TCCTTCTTCTTGTACTCCAGGCTGACCGTGGATAAGTCCAGGTGGCAGGAAGGCAACG |
| | | | | TGTTCAGCTGCTCCGTGATGCACGAGGCCCTGCACAATCACTACACCCAGAAGTCCCT |
| | | | | GAGCCTGTCCCCTGGGAAAG |
| 147 | NORI-011 | Amino acid sequence of CDRL1 using IMGT | CDRL1 (IMGT) | SSDVGFYNF |
| 148 | NORI-011 | Amino acid sequence of CDRL2 using IMGT | CDRL2 (IMGT) | EVS |
| 148 | NORI-011 | Amino acid sequence of CDRL3 using IMGT | CDRL3 (IMGT) | SSYAGSNKW |
| 165 | NORI-011 | Amino acid sequence of CDRL1 using KABAT | CDRL1 (KABAT) | TGTSSDVGFYNFVS |
| 150 | NORI-011 | Amino acid sequence of CDRL2 using KABAT | CDRL2 (KABAT) | EVSKRPS |
| 148 | NORI-011 | Amino acid sequence of CDRL3 using KABAT | CDRL3 (KABAT) | SSYAGSNKW |
| 166 | NORI-011 | Amino acid sequence of VL | Light chain variable region | QSALTQPPSASGSPGQSVTISCTGTSSDVGFYNFVSWYQQHPDKAPKVMIYEVSKRPS |
| | | | | GVPDRFSGSKSGNTASLTVSGLQAEDEADYCSSYAGSNKVVFGGGTKLTVL |
| 174 | NORI-011 | Nucleic acid sequence of VL | Light chain variable region | CAGTCTGCCCTGACTCAGCCTCCCTCCGCGTCCGGGTCTCCTGGACAGTCAGTCACCA |
| | | | | TCTCCTGCACTGGAACCAGCAGTGACGTTGGTTTTTATAACTTTGTCTCCTGGTACCA |
| | | | | ACAGCACCCAGACAAAGCCCCAAAGTCATGATTTATGAGGTCAGTAAGCGGCCCTCA |
| | | | | GGGGTCCCTGATCGCTTCTCTGGCTCCAAGTCTGGCAACACGGCCTCCCTGACCGTCT |
| | | | | CTGGGCTCCAGGCTGAGGATGAGGCTGACTATTACTGCAGCTCATATGCAGGCAGCAA |
| | | | | CAAAGTGGTTTTCGGCGGAGGGACCAAGTTGACCGTCCTA |
| 168 | NORI-011 | Amino acid sequence Full light chain sequence | | QSALTQPPSASGSPGQSVTISCTGTSSDVGFYNFVSWYQQHPDKAPKVMIYEVSKRPS |
| | | | | GVPDRFSGSKSGNTASLTVSGLQAEDEADYCSSYAGSNKVVFGGGTKLTVLGQPKAA |
| | | | | PSVTLFPPSSEELQANKATLVCLISDFYPGAVTVAWKADSSPVKAGVETTTPSKQSNN |
| | | | | KYAASSYLSLTPEQWKSHRSYSCQVTHEGSTVEKTVAPTECS |
| 175 | NORI-011 | Nucleic acid sequence Full light chain sequence | | CAGTCTGCCCTGACTCAGCCTCCCTCCGCGTCCGGGTCTCCTGGACAGTCAGTCACCA |
| | | | | TCTCCTGCACTGGAACCAGCAGTGACGTTGGTTTTTATAACTTTGTCTCCTGGTACCA |
| | | | | ACAGCACCCAGACAAAGCCCCAAAGTCATGATTTATGAGGTCAGTAAGCGGCCCTCA |
| | | | | GGGGTCCCTGATCGCTTCTCTGGCTCCAAGTCTGGCAACACGGCCTCCCTGACCGTCT |
| | | | | CTGGGCTCCAGGCTGAGGATGAGGCTGACTATTACTGCAGCTCATATGCAGGCAGCAA |
| | | | | CAAAGTGGTTTTCGGCGGAGGGACCAAGTTGACCGTCCTAGGAGCAGCCAAAAAGCAGCC |
| | | | | CCATCCTGTAACCTCTGTTCCCACCTAGTTCAGAGGAGCTTCAAGCAAACAAAGCCACAC |
| | | | | TTGTTTGCCTTATTAGTGATTTTATCCCCGTGCCCTGACCAGTTGCCTGGAAGCTGA |

-continued

| SEQ ID NO | | Description | Sequence |
|---|---|---|---|
| | | | TAGCTCACCAGTGAAAGCTGGCGTGGAGACAACCACCACCATCTAAACAAAGCAATAAC AAGTATGGTGCCAGCTCATATGTGACCTGAGTCTCCACTCCAGAACAATGGAAGTCTCATCGGT CCTATAGCTCGTCAAGTGACCCACGAAGGCAGTACCGTCGAGAAGACCCGTGCCACCAAC AGAGTGTAGC |
| 155 | NORI-011-M | CDRH1 (IMGT) | Amino acid sequence of CDRH1 using IMGT GFTFDDHV |
| 137 | NORI-011-M | CDRH2 (IMGT) | Amino acid sequence of CDRH2 using IMGT ISWNSDTI |
| 156 | NORI-011-M | CDRH3 (IMGT) | Amino acid sequence of CDRH3 using IMGT AREKDGDFYNYFVMDV |
| 157 | NORI-011-M | CDRH1 (KABAT) | Amino acid sequence of CDRH1 using Kabat DHVMY |
| 158 | NORI-011-M | CDRH2 (KABAT ) | Amino acid sequence of CDRH2 using Kabat GISWNSDTIGYADAVRG |
| 159 | NORI-011-M | CDRH3 (KABAT) | Amino acid sequence of CDRH3 using Kabat EKDGDFYNYFVMDV |
| 176 | NORI-011-M | Heavy chain variable region | Amino acid sequence of VH EVQLVESGGGLVQPGRSLRLSCAASGFTFDDHVMYWVRQGPGRGLEWVSGIS WNSDTIGYADAVRGRFTISRDNARNVLYLQMNSLRPEDTALYYCARERDGDFYNYFV MDVWGQGTMVTVSS |
| 177 | NORI-011-M | Heavy chain variable region | Nucleic acid sequence of VH GAAGTGCAGTTGGTGGAGTCTGGGGGAGGCTTGGTACAGCCTGGCAGGTCCC TGAGACTCTCCTGTGCAGCCTCTGGATTCACCTTTGATGATCATGTCATGTATTGGGT CCGGCAAGGTCCAGGGAAGGGCCTGGAGTGGGTCTCAGGTATTAGTTGGAATAGTGAT ACCATTGGCTATGCCGACGCGTGTGAAGGGCCGATTCACCATCTCCAGAGACAACGCCA AGAACGTCCTATATCTGCAAATGAACAGTCTGAGACCTGAGGACACGGCCTTGTATTA CTGTGCAAGAGAGAAAGACGGTGACTTTACTATAACTACTTCGTTATGGACGTCTGG GGCCAAGGGACAATGGTCACCGTCTCTTCA |
| 178 | NORI-011-M | Full heavy chain sequence | Amino acid sequence heavy chain EVQLVESGGGLVQPGRSLRLSCAASGFTFDDHVMYWVRQGPGRGLEWVSGIS WNSDTIGYADAVRGRFTISRDNARNVLYLQMNSLRPEDTALYYCARERDGDFYNYFV MDVWGQGTMVTVSSASTRGPSVFPLAPCSRSTSESTAALGCLVRDYFPEPVTVSWNSG ALTSGVHTFPAVLQSSGLYSLSSVVTVPSSSLGTKTYTCNVDHKPSNTKVDKRVESKY GPPCPPCPAPEFEGGPSVFLFPPKPKDTLMISRTPEVTCVVVDVSQEDPEVQFNWYVD GVEVHNARTRPREEQFNSTYRVVSVLTVLHQDWLNGREYRCRVSNRGLPSSIERTISR AKGQPREPQVYTLPPSQEEMTKNQVSLTCLVKGFYPSDIAVEWESNGQPENNYKTTPP VLDSDGSFFLYSRLTVDRSRWQEGNVFSCSVMHEALHNHYTQRSLSLSLGR |
| 179 | NORI-011-M | Full heavy chain sequence | Nucleic acid sequence heavy chain GAAGTGCAGTTGGTGGAGTCTGGGGGAGGCTTGGTACAGCCTGGCAGGTCCC TGAGACTCTCCTGTGCAGCCTCTGGATTCACCTTTGATGATCATGTCATGTATTGGGT CCGGCAAGGTCCAGGGAAGGGCCTGGAGTGGGTCTCAGGTATTAGTTGGAATAGTGAT ACCATTGGCTATGCCGACGCGTGTGAAGGGCCGATTCACCATCTCCAGAGACAACGCCA AGAACGTCCTATATCTGCAAATGAACAGTCTGAGGACCTGAGGACACGGCCTTGTATTA CTGTGCAAGAGAGAAAGACGGTGACTTTTACTATAACTACTTCGTTATGGACGTCTGG |

-continued

| SEQ ID NO | | Description | | Sequence |
|---|---|---|---|---|
| | | | | GGCCAAGGGACAATGGTCACCGTCTCTTCAGCCAGCACCAAGGGCCCTTCCGTGTTCC |
| | | | | CCCTGGCCCCCTGCAGCAGGAGCACCTCCGAATCCACAGTCCCTGGCGTGTCTGGT |
| | | | | GAAGGACTACTTTCCCGAGCCCGTGACCGTGAGCTGGAACAGCGGCGCTCTGACATCC |
| | | | | GGCGTCCACACCTTTCCTGCCGTCCTCCAGTCTCCGGCCTCTACTCCCTGTCTCCG |
| | | | | TGGTGACCGTGCCTAGCTCCTCCGGCACCAAGACCTACACCTGTAACGTGGACCA |
| | | | | CAAACCTCCAACACCAAGGTGGACAAACGGGTGGACAAGAACGGTCGAGAGCCCTCCCTGC |
| | | | | CCTCCTTGTCTCCTGCCCCCGAGTTCGAAGGCGGACCCAGCGTGTTCCTGTTCCCTCCTA |
| | | | | AGCCCAAGGACACCCTCATGATCAGCCGGACACCCGAGGTGACCTGCGTGGTGGTGGA |
| | | | | TGTGAGCCAGGAGGACCCTGAGGTCCAGTTCAACTGGTATGTGGATGGCGTGGAGGTG |
| | | | | CACAACGCCAAGACAAAGCCCCGGGAAGAGCAGTTCAACTCCACCTACAGGGTGGTCA |
| | | | | GCGTGCTGACCGTGCTGCATCAGGACTGGCTGAACGGCAAGGAGTACAAGTGCAAGGT |
| | | | | CAGCAATAAGGGACTGCCCAGCAGCATCGAGAAGACCATCTCCAAGGCTAAAGGCCAG |
| | | | | CCCCGGGAACCTCAGGTGTACACCCTGCCTCCAGGAGGAGATGAGTGACCAAGAACC |
| | | | | AGGTGAGCCTGACCTGCCTGGTGAAGGGATTCTACCCTTCCGACATCGCCGTGGAGTG |
| | | | | GGAGTCCAACGGCCAGCCAGAGAACAATTATAAGACCACCCCTCCCGTCCTCGACAGC |
| | | | | GACGGCTCCTTCTTTCTGTACTCCAAGCTGACCGTGGATAAGTCCAGGTGGCAGGAAG |
| | | | | GCAACGTGTTCAGCTGCTCCGTGATGCACGAGGCCCTGCACAATCACTACACCCAGAA |
| | | | | GTCCCTGAGCCTGTCCCTGGGAAAAG |
| 164 | NORI-011-M | CDRL1 (IMGT) | Amino acid sequence of CDRL1 using IMGT | SSDVGFYNF |
| 147 | NORI-011-M | CDRL2 (IMGT) | Amino acid sequence of CDRL2 using IMGT | EVS |
| 148 | NORI-011-M | CDRL3 (IMGT) | Amino acid sequence of CDRL3 using IMGT | SSYAGSNKW |
| 165 | NORI-011-M | CDRL1 (KABAT) | Amino acid sequence of CDRL1 using KABAT | TGTSSDVGFYNFVS |
| 150 | NORI-011-M | CDRL2 (KABAT) | Amino acid sequence of CDRL2 using KABAT | EVSKRPS |
| 148 | NORI-011-M | CDRL3 (KABAT) | Amino acid sequence of CDRL3 using KABAT | SSYAGSNKW |
| 166 | NORI-011-M | Light chain variable region | Amino acid sequence of VL | QSALTQPPSASGSPGQSVTISCTGTSSDVGFYNFVSWYQQHPDKAPKVMIYE VSKRPSGVPDRFSGSKSGNTASLTVSGLQAEDEADYCSSYAGSNKVVFGGGTKLTVL |
| 180 | NORI-011-M | Light chain variable region | Nucleic acid sequence of VL | CAGTCTGCCCTGACTCAGCCTCCCTCCGCGTCCGGGTCTCCTGGACAGTCAG TCACCATCTCCTGCACTGGAACCAGCAGTGACGTTGGTTTTATAACTTTGTCTCCTG GTACCAACAGCACCCAGACAAAGCCCCAAAGTCATGATTTATGAGGTCAGTAAGCGG CCCTCAGGGGTCCCTGATCGCTTCTCTGGCTCCAAGACGGCCTCCCTGA CCGTCTCTGGGCTCCAGGCTGAGGATGAGGCTGACTATTACTGCAGCTCATATGCAGG CAGCAACAAGTGGTTTTCGCGGAGGGACCAAGTTGACCGTCCTA |

| SEQ ID NO | | Description | Sequence |
|---|---|---|---|
| 168 | NORI-011-M | Full light chain sequence | Amino acid sequence light chain | QSALTQPPSASGSPGQSVTISCTGTSSDVGFYNFVSWYQQHPDKAPKVMIYE VSKRPSGVPDRFSGSKSGNTASLTVSGLQAEDEADYYCSSYAGSNKVVFGGGTKLTVL GQPKAAPSVTLFPPSSEELQANKATIVCLISDFYPGAVTVAWKADSSPVKAGVETTTP SKQSNNKYAASSYLSLTPEQWKSHRSYSCQVTHEGSTVEKTVAPTECS |
| 181 | NORI-011-M | Full light chain sequence | Nucleic acid sequence light chain | CAGTCTGCCCTGACTCAGCCTCCCTCCGCGTCCGGGTCTCCTGGACAGTCAG TCACCATCTCCTGCACTGGAACCAGCAGTGACGTGGTTTTATAACTTTGTCTCCTG GTACCAACAGCACCCAGACAAAGCCCCAAAGTCATGATTTATGAGGTCAGTAAGCGG CCCTCAGGGGTCCCTGATCGCTTCTCTGGCTCCAAGTCTGGCAACACGGCCTCCCTGA CCGTCTCTGGGCTCCAGGCTGAGGATGAGGCTGACTATTACTGCAGCTCATATGCAGG CAGCAACAAAGTGGTTTCGGCGGAGGGACCAAGTTGACCGTCCTAGGACAGCCAAA GCAGCCCATCCGTAACTCTGTTCCCACCTAGTTCAGATGAGGAGCTTCAAGCAAACAAAG CCACACTGTTTGCCTTATTAGTGATTTTATCCCGGTGACCGTAGCGTTGCCTGAA AGGTGATAGCTCACCAGTGAAAGCTGGCGTGGAGACAACCACCATCTAAACAAAGC AATAACAAGTATGGTGCCAGCTCATATGTGAGTCTCACTCCAGACAATGGAAGTCTC ATCGGTCCTATAGCTGTCAAGTGACCCACGGAGGCAGTACCGTCGAGAAGACCGTGGC ACCAACAGAGTGTAGC |
| 155 | NORI-012 | CDRH1 (IMGT) | Amino acid sequence of CDRH1 using IMGT | GFTFDDHV |
| 137 | NORI-012 | CDRH2 (IMGT) | Amino acid sequence of CDRH2 using IMGT | ISWNSDTI |
| 156 | NORI-012 | CDRH3 (IMGT) | Amino acid sequence of CDRH3 using IMGT | AREKDGDFYYNYFVMDV |
| 157 | NORI-012 | CDRH1 (KABAT) | Amino acid sequence of CDRH1 using Kabat | DHVMY |
| 158 | NORI-012 | CDRH2 (KABAT) | Amino acid sequence of CDRH2 using Kabat | GISWNSDTIGYADAVKG |
| 159 | NORI-012 | CDRH3 (KABAT) | Amino acid sequence of CDRH3 using Kabat | EKDGDFYYNYFVMDV |
| 182 | NORI-012 | Heavy chain variable region | Amino acid sequence of VH | EVQLVESGGGLVQPGRSLRLSCAASGFTFDDHVMVWVRQAPGKGLEWVSGISWNSDTI GYADAVKGRFTISRDNAKNVLYLHMNSLRPEDTALYYCAREKDGDFYYNYFVMDVWGQ GTTVTVSP |
| 183 | NORI-012 | Heavy chain variable region | Nucleic acid sequence of VH | GAAGTGCAGTTAGTGGAGTCTGGGGGAGGCTTGGTACAGCCTGGCAGGTCCCTGAGAC TCTCCTGTGCAGCCTCTGGATTCACCTTTGATGATCATGTCATGTATTGGGTCCGGCA AGCTCCAGGGAAGGGCCTGGAGTGGGTCTCAGGTATTAGTTGGAATAGTGATACCATT GGCTATGCGGACGCGTGAAGGGCCGATTCACCATCTCCAGAGACAACGCCAAGAACG TCCTATATCTGCACATGAACAGTCTGAGACCTGAGACACCTGAGACACCGCCTTATATTACTGTGC GAGAGAAAGACGGTGACTTTTACTATAACTACTTCGTTATGGACGTCTGGGGCCAA GGGACCACGGTCACCGTCTCCCCA |

-continued

| SEQ ID NO | | Description | Sequence |
|---|---|---|---|
| 184 | NORI-012 | Full heavy chain sequence | Amino acid sequence heavy chain | EVQLVESGGGLVQPGRSLRLSCAASGFTFDDHVMTWVRQAPGKGLEWVSGISWNSDTI GYADAVKGRFTISRDNAKNVLYLHMNSLRPEDTALYYCAAREKDGDFYNYFVMDVWGQ GTTVTVSPASTKGPSVFPLAPCSRSTSESTAALGCLVKDYFPEPVTVSWNSGALTSGV HTFPAVLQSSGLYSLSSVVTVPSSSLGTKTYTCNVDHKPSNTKVDKRVESKYGPPCPP CPAPEFEGGPSVFLFPPKPKDTLMISRTPEVTCVVVDVSQEDPEVQFNWYVDGVEVHN AKTKPREEQFNSTYRVVSVLTVLHQDWLNGKEYKCKVSNKGLPSSIEKTISKAKGQPR EPQVYTLPPSQEEMTKNQVSLTCLVKGFYPSDIAVEWESNGQPENNYKTTPPVLDSDG SFFLYSRLTVDKSRWQEGNVFSCSVMHEALHNHYTQKSLSLSLGK |
| 185 | NORI-012 | Full heavy chain sequence | Nucleic acid sequence heavy chain | GAAGTGCAGTTAGTGGAGTCTGGGGGAGGCTTGGTACAGCCTGGCAGGTCCCTGAGAC TCTCCTGTGCAGCCTCTGGATTCACCTTTGATGATCATGTCATGACTTGGGTCCGGCA AGCTCCAGGGAAGGGCCTGGAGTGGGTCTCAGGTATTAGTTGGAATAGTGATACCATT GGCTATGCGGACGCTGTGAAGGGCCGATTCACCATCTCCAGAGACAACGCCAAGAACG TCCTATATCTGCACATGAACAGTCTGAGACCTGAGGACACGGCCTTATATTACTGTGC GAGAGAAAAGACGGTGACTTTTACTATAACTACTTCGTTATGGACGTCTGGGGCCAA GGGACCACGGTCACCGTCTCCCCAGCCAGCACCAAGGGCCCCTCCGTGTTCCCCCTGG CCCCTTGCAGCAGGAGCACCTCCGAATCCACAGCTGCCCTGGGCTGCCTGGTCAAGGA CTACTTTCCCGAGCCCGTGACCGTGAGCTGGAACAGCGGCGCCCTGACATCCGGCGTC CACACCTTTCCTGCCGTCCTGCAGTCCTCCGGCCTCTACTCCCTGTCCTCCGTGGTGA CCGTGCCTAGCTCCTCCCTGGGACCAAGACCTACACCTGTAACGTGACCACACAACC CTCCAACACCAAGGTGGACAAGGGTGAGACCAAGTACGGCCCCCCCTGCCCTCCT TGTCCTGCCCCCGAGTTCGAAGGCGGACCCAGCGTGTTCCTGTTCCCTCCTAAGCCCA AGGACACCCTCATGATCAGCCGGACACCCGAGGTGACCTGCGTGGTGGTGGATGTGAG CCAGGAGGACCCCGAGGTCCAGTTCAACTGGTATGTGGATGGCGTGGAGGTGCACAAC GCCAAGACAAAGCCCCGGGAGGAGCAGTTCAACTCCACCTACAGGGTGGTCAGCGTGC TGACCGTGCTGCTGCATCAGGACTGGCTGAACGGCAAGGAGTACAAGTCAAGTCAGCAA TAAGGACTGCCCAGCAGCATCGAGAGAGACCATCTCAAGGCCAGGAGGAGAACCAGGTGA GCCTGACCTGCCTGGTGAAGGGATTCTACCCTTCCGACATCGCCGTGGAGTGGGAGTC CAACGGCCAGCCCGAGAACAATTATAAGACCACCCCTCCCGTCCTGGACAGCGACGGA TCCTTCTTTCTGTACTCCAGGCTGACCGTGGATAAGTCCAGGTGGCAGGAAGGCAACG TGTTCAGCTGCTCCGTGATGCACGAGGCCCTGCACAATCACTACACCCAGAAGTCCCT GAGCCTGTCCCTGGGAAAG |
| 164 | NORI-012 | CDRL1 (IMGT) | Amino acid sequence of CDRL1 using IMGT | SSDVGFYNF |
| 147 | NORI-012 | CDRL2 (IMGT) | Amino acid sequence of CDRL2 using IMGT | EVS |
| 148 | NORI-012 | CDRL3 (IMGT) | Amino acid sequence of CDRL3 using IMGT | SSYAGSNKW |
| 165 | NORI-012 | CDRL1 (KABAT) | Amino acid sequence of CDRL1 using KABAT | TGTSSDVGFYNFVS |
| 150 | NORI-012 | CDRL2 (KABAT) | Amino acid sequence of CDRL2 using KABAT | EVSKRPS |

| SEQ ID NO | | Description | | Sequence |
|---|---|---|---|---|
| 148 | NORI-012 | CDRL3 (KABAT) | Amino acid sequence of CDRL3 using KABAT | SSYAGSNKW |
| 166 | NORI-012 | Light chain variable region | Amino acid sequence of VL | QSALTQPPSASGSPGQSVTISCTGTSSDVGFYNFVSWYQQHPDKAPKVMIYEVSKRPS GVPDRFSGSKSGNTASLTVSGLQAEDEADYCSSYAGSNKWNFGGGTKLTVL |
| 186 | NORI-012 | Light chain variable region | Nucleic acid sequence of VL | CAGTCTGCCCTGACTCAGCCTCCCTCCGCGTCCGGGTCTCCTGGACAGTCAGTCACCA TCTCCTGCACTGGAACCAGCAGTGACGTTGGTTTTATAACTTTGTCTCCTGGTACCA ACAGCACCCAGACCCAAAGCCCCCAAAGTCATGATTTATGAGGTCAGTAAGCGGCCCTCA GGGGTCCCTGATCGCTTCTCTGGCTCCAAGTCTGGCAACACGGCCTCCCTGACCGTCT CTGGGCTCCAGGCTGAGGATGAGGCTGATTATTACTGCAGCTCATATGCAGGCAGCAA CAAAGTGGTTTTCGGCGGAGGGACCAAGTTGACCGTCCTA |
| 168 | NORI-012 | Full light chain sequence | Amino acid sequence light chain | QSALTQPPSASGSPGQSVTISCTGTSSDVGFYNFVSWYQQHPDKAPKVMIYEVSKRPS GVPDRFSGSKSGNTASLTVSGLQAEDEADYCSSYAGSNKVVFGGGTKLTVLGQPKAA PSVTLFPPSSEELQANKATLVCLISDFYPGAVTVAWKADSSPVKAGVETTTPSKQSNN KYAASSYLSLTPEQWKSHRSYSCQVTHEGSTVEKTVAPTECS |
| 187 | NORI-012 | Full light chain sequence | Nucleic acid sequence light chain | CAGTCTGCCCTGACTCAGCCTCCCTCCGCGTCCGGGTCTCCTGGACAGTCAGTCACCA TCTCCTGCACTGGAACCAGCAGTGACGTTGGTTTTATAACTTTGTCTCCTGGTACCA ACAGCACCCAGACCCAAAGCCCCCAAAGTCATGATTTATGAGGTCAGTAAGCGGCCCTCA GGGGTCCCTGATCGCTTCTCTGGCTCCAAGTCTGGCAACACGGCCTCCCTGACCGTCT CTGGGCTCCAGGCTGAGGATGAGGCTGATTATTACTGCAGCTCATATGCAGGCAGCAA CAAAGTGGTTTTCGGCGGAGGGACCAAGTTGACCGTCCTAGGTCAGCCCAAGGCTGCC CCATCCGTAACTCTGTTCCCACCTTCTGAGGAGCTTCAAGCCAACAAGGCCACACTGA TAGCTCACCAGTGAAAGCTGCCGTGGAGACAACCACCATCTAAACAAAGCAATAAC AAGTATGCTGCCAGCTCATATGTGAGTCTCACTCCAGAACAATGGAAGTCTCATCGT CCTATAGCTGTCAAGTGACCCCACGAGGCAGTACCGTGGAGAAGACCGTGGCCACCAAC AGAGTGTAGC |
| 188 | NORI-013 | CDRH1 (IMGT) | Amino acid sequence of CDRH1 using IMGT | GFTFDEHV |
| 189 | NORI-013 | CDRH2 (IMGT) | Amino acid sequence of CDRH2 using IMGT | ISWKSDII |
| 190 | NORI-013 | CDRH3 (IMGT) | Amino acid sequence of CDRH3 using IMGT | AREKDGDFYYYFAMDV |
| 191 | NORI-013 | CDRH1 (KABAT) | Amino acid sequence of CDRH1 using Kabat | EHVIY |
| 192 | NORI-013 | CDRH2 (KABAT) | Amino acid sequence of CDRH2 using Kabat | SISWKSDIIAYADSVKG |
| 193 | NORI-013 | CDRH3 (KABAT) | Amino acid sequence of CDRH3 using Kabat | EKDGDFYYYFAMDV |

-continued

| SEQ ID NO | | Description | Sequence |
|---|---|---|---|
| 194 | NORI-013 | Heavy chain variable region | Amino acid sequence of VH | EVQLVESGGGLIQAGRSLRLSCAASGFTFDEHVIYWVRQIPGKGLEWISSISWKSDII AYADSVKGRFTISRDNAKNALYLQMNSLRAEDTALYYCARRKDGDFYYYFAMDVWGQ GTTVTVSS |
| 195 | NORI-013 | Heavy chain variable region | Nucleic acid sequence of VH | GAGGTGCAGCTGGTTGAATCTGGCGGAGGACTGATCCAGGCCGGCAGATCTCTGAGAC TGTCTTGTGCCGCCTCCGGCTTCACCTTCGATGAGCACGTGATCTACTGGGTCCGACA GATCCCTGGCAAGGCCTGGAATGGAGTCTCCTCCATCTCCTGGAAGTCCGACATCATT GCCTACGCCGACTCCGATGAACTCCCTGAGAGCCAGATTCACCATCTCCAGAGACACCGCCAAGAACG CCCTGTACCTGCAGATGAACTCCCTGAGAGCCGAGGACACCGCCTGTACTACTGCGC CAGAGAAAGGACGGCGACTTTTACTACTACTATTTCGCCATGGACGTGTGGGGCCAG GGCACCACAGTGACAGTTTCTTCT |
| 196 | NORI-013 | Full heavy chain sequence | Amino acid sequence heavy chain | EVQLVESGGGLIQAGRSLRLSCAASGFTFDEHVIYWVRQIPGKGLEWISSISWKSDII AYADSVKGRFTISRDNAKNALYLQMNSLRAEDTALYYCARRKDGDFYYYFAMDVWGQ GTTVTVSSASTKGPSVFPLAPCSRSTSESTAALGCLVKDYFPEPVTVSWNSGALITSGV HTFPAVLQSSGLYSLSSVVTVPSSSLGTKTYTCNVDHKPSNTKVDKRVESKYGPPCPP CPAPEFEGGPSVFLFPPKPKDTLMISRTPEVTCVVVDVSQEDPEVQFNWYVDGVEVHN AKTKPREEQFNSTYRVVSVLTVLHQDWLNGKEYKCKVSNKGLPSSIEKTISKAKGQPR EPQVYTLPPSQEEMTKNQVSLTCLVKGFYPSDIAVEWESNGQPENNYKTTPPVLDSDG SFFLYSRLTVDKSRWQEGNVFSCSVMHEALHNHYTQKSLSLSLGK |
| 197 | NORI-013 | Full heavy chain sequence | Nucleic acid sequence heavy chain | GAGGTGCAGCTGGTTGAATCTGGCGGAGGACTGATCCAGGCCGGCAGATCTCTGAGAC TGTCTTGTGCCGCCTCCGGCTTCACCTTCGATGAGCACGTGATCTACTGGGTCCGACA GATCCCTGGCAAGGCCTGGAATGGAGTCTCCTCCATCTCCTGGAAGTCCGACATCATT GCCTACGCCGACTCCGATGAACTCCCTGAAGGGCCAGATTCACCATCTCCAGAGACACG CCCTGTACCTGCAGATGAACTCCCTGAGAGCCGAGGACACCGCCTCTGTACTACTGCGC CAGAGAAAGGACGGCGACTTTTACTACTACTATTTCGCCATGGACGTGTGGGGCCAG GGCACCACAGTGACAGTTTCTTCTGCCAGCTCCACCAAGGGCCCTCCGTGTTCCCCCTGG CCCCTTGCAGCAGGAGCACCTCGAATCCACAGCTGCCCTGGGCTGTCTGGTGAAGGA CTACTTTCCCGAGCCCGTGACCGTGAGCTGGAACAGCGGCGCGCTCTTGACATCCGGCGTC CACACCTTTCCTGCCGTGCTGCAGTCCTCCGGCCTCTACCTCCCTGTCCTCCGTGGTGA CCGTGCCTAGCTCCTCCGGCCACCAAGACCTACACCTGTAACGTGGACCACAAAACC CTCCAACACCAAGGTGCAACAGCGGCGACCCAGCGTGTTCCTGTTCCCTCCTCCTGCCCTCCT TGTCCTGCCCCCGAGTTCGAAGGCGGACCCAGCGTGTTCCTGTTCCTGCCTGTGGTGATGTGAG AGGACACCCTCATGATCAGCCGGACACACCGAGGTGACCTGCGTGGTGGTGGAGGTGCACAAC CGCAAGACAAAGCCCCGGAAGAGCAGTTCAACTCCACCTACAGGGTGGTCAGCGTGC TGACCGTGCTGCATCAGGACTGGCTGAACGGCAAGGAGTACAAGTGCAAGGTCAGCAA TAAGGGACTGCCCAGCAGCATCGAGAAGACCATCTCCAAGGCTAAAGGCCAGCCCCGG GAACCTCAGGTGTACACCCTGCCTCCCAGCAGGAGATGACCAAGAACCAGGTGA GCCTGACCTGCCTGGTGAAGGGATTCTACCCTTCCGACATCGCCGTGGAGTGGGAGTC CAACGGCCAGCCCGAGAACAATTATAGACCCACCCCTCCCGTCCTGGACAGCGACGGA TCCTTCTTTCTGTACTCCAGGCTGACCGTGGATAAGTCCAGGTGGCAGGAAGGCAACG TGTTCAGCTGCTCCGTGATGCACGAGGCCCTGCACAATCACTACACCCAGAAGTCCCT GAGCCTGTCCCTGGGAAAG |
| 146 | NORI-013 | CDRL1 (IMGT) | Amino acid sequence of CDRL1 using IMGT | SSDVGYYNY |

-continued

| SEQ ID NO | | Description | Sequence |
|---|---|---|---|
| 147 | NORI-013 | Amino acid sequence of CDRL2 using IMGT | EVS |
| 148 | NORI-013 | Amino acid sequence of CDRL3 using IMGT | SSYAGSNKW |
| 149 | NORI-013 | Amino acid sequence of CDRL1 using KABAT | TGTSSDVGYYNYVS |
| 150 | NORI-013 | Amino acid sequence of CDRL2 using KABAT | EVSKRPS |
| 148 | NORI-013 | Amino acid sequence of CDRL3 using KABAT | SSYAGSNKW |
| 151 | NORI-013 | Light chain variable region | QSALTQPPSASGSPGQSVTLSCTGTSSDVGYYNYVSWYLQHPGKAPKLMIYEVSKRPS GVPDRFSGSKSANTASLTVSGLQAEDEADYYCSSYAGSNKVVFGGGTKVTVL |
| 198 | NORI-013 | Nucleic acid sequence of VL | CAGTCTGCCCTGACTCAGCCTCCCTCCGGGTCTCCTGGACAGTCAGTCACCC TCTCCTGCACTGGAACCAGTAGTGACGTTGGTTATTATAACTATGTCTCCTGGTACCT ACAGCACCCAGGCAAAGCCCCCAAACTCATGATTTATGAGGTCAGTAAGCGGCCCTCA GGGGTCCCTGATCGCTTTTCTGGCTCCAAGTCTGCCAACACGGCCTCCCTGACCGTCT CTGGGCTCCAGGCTGAGGATGAGGCTGATTATTATTGCAGTCATATGCAGGCAGCAA CAAAGTGGTATTCGGCGGAGGGACCAAGGTGACCGTCCTA |
| 153 | NORI-013 | Amino acid Full light chain sequence | QSALTQPPSASGSPGQSVTLSCTGTSSDVGYYNYVSWYLQHPGKAPKLMIYEVSKRPS GVPDRFSGSKSANTASLTVSGLQAEDEADYYCSSYAGSNKVVFGGGTKVTVLGQPKAA PSVTLFPPSSEELQANKATLVCLISDFYPGAVTVAWKADSSPVKAGVETTTPSKQSNN KYAASSYLSLTPEQWKSHRSYSCQVTHEGSTVEKTVAPTECS |
| 199 | NORI-013 | Nucleic acid Full light chain sequence | CAGTCTGCCCTGACTCAGCCTCCCTCCGGGTCTCCTGGACAGTCAGTCACCC TCTCCTGCACTGGAACCAGTAGTGACGTTGGTTATTATAACTATGTCTCCTGGTACCT ACAGCACCCAGGCAAAGCCCCCAAACTCATGATTTATGAGGTCAGTAAGCGGCCCTCA GGGGTCCCTGATCGCTTTTCTGGCTCCAAGTCTGCCAACACGGCCTCCCTGACCGTCT CTGGGCTCCAGGCTGAGGATGAGGCTGATTATTATTGCAGTCATATGCAGGCAGCAA CAAAGTGGTATTCGGCGGAGGGACCAAGGTGACCGTCCTAGGTCAGCCCAAGGCTGCA CCATCCGTAACTCTGTTCCCACCTAGTTCAGAGGAGCTTCAAGCAACAAAGCCACAC TTGTTTGCCTTATTAGTGATTTTTATCCCGGTGCCGTGACAGTTGCCTGGAAGGCTGA TAGCTCACCAGTGAAAGCTGGCGTGGAGACAACCACACCATCTAAACAAAGCAATAAC AAGTATGCGCCAGCTCATATGTGAGTCCACTCCAGAACAATGGAAGTCTCATCGGT CCTATAGCTGTCAAGTGACCCACGAAGGCCAGTACCGTGCGAGAAGACCGTGCCACCAAC AGAGTGTAGC |
| 188 | NORI-014 | Amino acid sequence of CDRH1 using IMGT | GFTFDEHV |
| 200 | NORI-014 | Amino acid sequence of CDRH2 using IMGT | ITWKSDII |

-continued

| SEQ ID NO | | Description | Sequence |
|---|---|---|---|
| 190 | NORI-014 | CDRH3 (IMGT) | Amino acid sequence of CDRH3 using IMGT | AREKDGDFYYYFAMDV |
| 201 | NORI-014 | CDRH1 (KABAT) | Amino acid sequence of CDRH1 using Kabat | EHVMY |
| 202 | NORI-014 | CDRH2 (KABAT) | Amino acid sequence of CDRH2 using Kabat | SITWKSDIIAYADSVKG |
| 193 | NORI-014 | CDRH3 (KABAT) | Amino acid sequence of CDRH3 using Kabat | EKDGDFYYYFAMDV |
| 203 | NORI-014 | Heavy chain variable region | Amino acid sequence of VH | EVQLVESGGGLIQAGRSLRLSCAASGFTFDEHVMYWVRQIPGKGLEWISSITWKSDII<br>AYADSVKGRFTISRDNAKNALYLQMNSLRAEDTALYYCAREKDGDFYYYFAMDVWGQ<br>GTTVTVSS |
| 204 | NORI-014 | Heavy chain variable region | Nucleic acid sequence of VH | GAGGTGCAGCTGGTTGAATCTGGCGGAGGACTGATCCAGGCCGGCAGATCTCTGAGAC<br>TGTCTTGTGCCGCCTCCGGCTTCACCTTCGATGAGCACGTGATGTACTGGGTCCGACA<br>GATCCCTGGCAAAGGCCTGGAATGGAGTCTCCTCCATCACCTGGAAGTCCGACATCATT<br>GCCTACGCCGACTCCGTGAAGGGCAGATTCACCATCTCCAGAGACAACGCCAAGAACG<br>CCCTGTACCTGCAGATGAACTCCCTGAGAGCCGAGGACACCGCCCTGTACTACTGCGC<br>CAGAGAGAAGGACGGCGACTTTTACTACTACTATTTCGCCATGGACGTGTGGGGCCAG<br>GGCACCACAGTGACAGTTTCTTCT |
| 205 | NORI-014 | Full heavy chain sequence | Amino acid sequence heavy chain | EVQLVESGGGLIQAGRSLRLSCAASGFTFDEHVMYWVRQIPGKGLEWISSITWKSDII<br>AYADSVKGRFTISRDNAKNALYLQMNSLRAEDTALYYCAREKDGDFYYYFAMDVWGQ<br>GTTVTVSSASTKGPSVFPLAPCSRSTSESTAALGCLVKDYFPEPVTVSWNSGALTSGV<br>HTFPAVLQSSGLYSLSSVVTVPSSSLGTKTYTCNVDHKPSNTKVDKRVESKYGPPCPP<br>CPAPEFEGGPSVFLFPPKPKDTLMISRTPEVTCVVVDVSQEDPEVQFNWYVDGVEVHN<br>AKTKPREEQFNSTYRWSVLTVLHQDWLNGKEYKCKVSNKGLPSSIEKTISKAKGQPR<br>EPQVVTLPPSQEEMTKNQVSLTCLVKGFYPSDIAVEWESNGQPENNYKTTPPVLDSDG<br>SFFLYSRLTVDKSRWQEGNVFSCSVMHEALHNHYTQKSLSLSLGK |
| 206 | NORI-014 | Full heavy chain sequence | Nucleic acid sequence heavy chain | GAGGTGCAGCTGGTTGAATCTGGCGGAGGACTGATCCAGGCCGGCAGATCTCTGAGAC<br>TGTCTTGTGCCGCCTCCGGCTTCACCTTCGATGAGCACGTGATGTACTGGGTCCGACA<br>GATCCCTGGCAAAGGCCTGGAATGGAGTCTCCTCCATCACCTGGAAGTCCGACATCATT<br>GCCTACGCCGACTCCGTGAAGGGCAGATTCACCATCTCCAGAGACAACGCCAAGAACG<br>CCCTGTACCTGCAGATGAACTCCCTGAGAGCCGAGGACACCGCCCTGTACTACTGCGC<br>CAGAGAGAAGGACGGCGACTTTTACTACTACTATTTCGCCATGGACGTGTGGGGCCAG<br>GGCACCACAGTGACAGTTTCTTCTGCCAGCACCAAGGGCCCTTCCGTGTTCCCCCTGG<br>CTACTTTCCCAGCAGAGGCACCCCGGAATCCCAGCTGCCTGCCCTGGCGTGTCTGGTGAAGGA<br>CTACTTTCCCGAGCCCGTGACCGTGAGCTGGAACTCCGGCGCTCTGACATCCGGCGTC<br>CACACCTTTCCTGCCGTCCTCCTGGCACCAAGACCTACACCTGTAACGTGGACCACAAAACC<br>CCGTGCCTAGCTCCTCCCTGGCACCAAGACCTACACCTGTAACGTGGACCACAAAACC<br>CTCCAACACCAAGGTGGACAAGCGGGTGGAGAGCAAGTACGGCCCTCCCTGCCCTCCT<br>TGTCCTGCCCCCGAGTTGAAGGCCGACACCCAGGCTGTTCCTGTTCCTCCTCCTAAGCCCA<br>AGGACACCCTCATGATCAGCCGGACACACCCGAGGTGACCTGCGTGGTGGTGATGTGAG<br>CCAGGAGGACCCCGAGGTGCAGTTCAACTGGTATGTGGATGGCGTGGAGGTGCACAAC<br>GCCAAGACAAAGCCCCGGGAAGAGCAGTTCAACTCCACCTACAGGGTGGTCAGCGTGC<br>TGACCGTGCTGCATCAGGACTGGCTGAACGGCAAGGAGTACAAGTGCAAGTCAGCAA |

-continued

| SEQ ID NO | | Description | | Sequence |
|---|---|---|---|---|
| | | | | TAAGGGACTGCCAGCAGCATCGAGAGAGACCATCTCCAAGGCTAAAGGCCAGCCCGG |
| | | | | GAACCTCAGTGTACACCTGCCTCCCAGCCAGGAGGAGATGACCAAGAACCAGTGA |
| | | | | GCCTGACCTGCCTGGTGAAGGGATTCTACCCTTCCGACATCGCCGTGGAGTGGGAGTC |
| | | | | CAACGGCCAGCCCGAGAACAATTATAAGACACCCCTCCCCTCCGACAGCGACGGA |
| | | | | TCCTTCTTTCTGTACTCCAGGCTGACCGTGGATAAGTCCAGGTGGCAGGAAGGCAACG |
| | | | | TGTTCAGCTGCTCCGTGATGCACGAGGCCCTGCACAATCACTACACCCAGAAGTCCCT |
| | | | | GAGCCTGTCCCTGGGAAAG |
| 146 | NORI-014 | Amino acid sequence of CDRL1 using IMGT | CDRL1 (IMGT) | SSDVGYYNY |
| 147 | NORI-014 | Amino acid sequence of CDRL2 using IMGT | CDRL2 (IMGT) | EVS |
| 148 | NORI-014 | Amino acid sequence of CDRL3 using IMGT | CDRL3 (IMGT) | SSYAGSNKW |
| 149 | NORI-014 | Amino acid sequence of CDRL1 using KABAT | CDRL1 (KABAT) | TGTSSDVGYYNVS |
| 150 | NORI-014 | Amino acid sequence of CDRL2 using KABAT | CDRL2 (KABAT) | EVSKRPS |
| 148 | NORI-014 | Amino acid sequence of CDRL3 using KABAT | CDRL3 (KABAT) | SSYAGSNKW |
| 151 | NORI-014 | Amino acid sequence of VL | Light chain variable region | QSALTQPPSASGSPGQSVTLSCTGTSSDVGYYNYVSWYLQHPGKAPKLMIYEVSKRPS |
| | | | | GVPDRFSGSKSANTASLTVSGLQAEDEADYCSSYAGSNKVVFGGGTKVTVL |
| 207 | NORI-014 | Nucleic acid sequence of VL | Light chain variable region | CAGTCTGCCCTGACTCAGCCTCCCTCCGCGTCCGGGTCTCCTGGACAGTCAGTCACCC |
| | | | | TCTCCTGCACTGGAACCAGTAGTGACGTTGGTTATTATAACTATGTCTCCTGGTACCT |
| | | | | ACAGCACCCAGGCAAAGCCCCCAAACTCATGATTTATGAGGTCAGTAAGCGGCCCTCA |
| | | | | GGGGTCCCTGATCGCTTTTCTGGCTCCAAGTCTGCCAACACGGCCCTCCCTGACCGTCT |
| | | | | CTGGGCTCCAGGCTGAGGATGAGGCTGATTATTATTGCAGCTCAATGCAGGCAGCAA |
| | | | | CAAAGTGGTATTCGGCGGAGGGACCAAGGTGACCGTCCTA |
| 153 | NORI-014 | Amino acid sequence Full light chain sequence | Full light chain sequence | QSALTQPPSASGSPGQSVTLSCTGTSSDVGYYNYVSWYLQHPGKAPKLMIYEVSKRPS |
| | | | | GVPDRFSGSKSANTASLTVSGLQAEDEADYCSSYAGSNKVVFGGGTKVTVLGQPKAA |
| | | | | PSVTLFPPSSEELQANKATLVCLISDFYPGAVTVAWKADSSPVKAGVETTTPSKQSNN |
| | | | | KYAASSYLSLTPEQWKSHRSYSCQVTHEGSTVEKTVAPTECS |
| 208 | NORI-014 | Nucleic acid sequence Full light chain sequence | Full light chain sequence | CAGTCTGCCCTGACTCAGCCTCCCTCCGCGTCCGGGTCTCCTGGACAGTCAGTCACCC |
| | | | | TCTCCTGCACTGGAACCAGTAGTGACGTTGGTTATTATAACTATGTCTCCTGGTACCT |
| | | | | ACAGCACCCAGGCAAAGCCCCCAAACTCATGATTTATGAGGTCAGTAAGCGGCCCTCA |
| | | | | GGGGTCCCTGATCGCTTTTCTGGCTCCAAGTCTGCCAACACGGCCCTCCCTGACCGTCT |
| | | | | CTGGGCTCCAGGCTGAGGATGAGGCTGATTATTATTGCAGCTCAATGCAGGCAGCAA |
| | | | | CAAAGTGGTATTCGGCGGAGGGACCAAGGTGACCGTCCTAGGACAGCCCAAAAGCAGCC |
| | | | | CCATCCGTAACTCTGTTCCCACCTAGTTCAGAGGAGCTTCAAGCAAACAAAGCCACAC |
| | | | | TTGTTTGCCTTATTAGTGATTTTATCCCGGTGCCTGACAGTTGCCTGGAAGCTGA |

-continued

| SEQ ID NO | | Description | Sequence |
|---|---|---|---|
| | | | TAGCTCACCAGTGAAAGCTGGCTGGAGACAACCACCACCATCTAAACAAAGCAATAAC AAGTATGCTGCCAGCTCATATGTGAGTCTCCACTCCAGAACAATGGAAGTCTCATCGGT CCTATAGCTGTCAAGTGACCCACGAAGGCAGTACCGTCGAGAAGACCGTGCACCAAC AGAGTGTAGC |
| 188 | NORI-015 | CDRH1 (IMGT) | Amino acid sequence of CDRH1 using IMGT | GFTFDEHV |
| 189 | NORI-015 | CDRH2 (IMGT) | Amino acid sequence of CDRH2 using IMGT | ISWKSDII |
| 190 | NORI-015 | CDRH3 (IMGT) | Amino acid sequence of CDRH3 using IMGT | AREKDGDFYYYFAMDV |
| 191 | NORI-015 | CDRH1 (KABAT) | Amino acid sequence of CDRH1 using Kabat | EHVIY |
| 192 | NORI-015 | CDRH2 (KABAT) | Amino acid sequence of CDRH2 using Kabat | SISWKSDIIAYADSVKG |
| 193 | NORI-015 | CDRH3 (KABAT) | Amino acid sequence of CDRH3 using Kabat | EKDGDFYYYFAMDV |
| 194 | NORI-015 | Heavy chain variable region | Amino acid sequence of VH | EVQLVESGGGLIQAGRSLRLSCAASGFTFDEHVIYWVRQIPGKGLEWISSISWKSDII AYADSVKGRFTISRDNAKNALYLQMNSLRAEDTALYYCAREKDGDFYYYFAMDVWGQ GTTVTVSS |
| 209 | NORI-015 | Heavy chain variable region | Nucleic acid sequence of VH | GAGGTGCAGCTGGTTGAAATCTGGCGGAGGACTGATCCAGGCCGGCAGATCTCTGAGAC TGTCTTGTGCCGCCTCCGGCTTCACCTTCGATGAGCACGTGATCTACTGGGTCCGACA GATCCCTGGCAAAGGCCTGGAATGGATCTCTCCATCTCCTGGAAGTCCGACATCATT GCCTACGCCGACTCCGTGAAGGGCAGATTCACCATCTCCAGAGACAACGCCAAGAACG CCCTGTACCTGCAGATGAACTCCCTGAGAGCCGAGGACACCGCTCTGTACTACTGCGC CAGAGAGAAGGACGGCGACTTTACTACTACTATTTCGCCATGGACGTGTGGGGCCAG GGCACCACAGTGACAGTTTCTTCT |
| 210 | NORI-015 | Full heavy chain sequence | Amino acid sequence heavy chain | EVQLVESGGGLIQAGRSLRLSCAASGFTFDEHVIYWVRQIPGKGLEWISSISWKSDII AYADSVKGRFTISRDNAKNALYLQMNSLRAEDTALYYCAREKDGDFYYYFAMDVWGQ GTTVTVSSASTKGPSVFPLAPCSRSTSESTAALGCLVKDYFPEPVTVSWNSGALTSGV HTFPAVLQSSGLYSLSSVVTVPSSSLGTKTYTCNVDHKPSNTKVDKRVESKYGPPCPP CPAPEFEGGPSVFLFPPKPKDTLMISRTPEVTCVVVDVSQEDPEVQFNWYVDGVEVHN AKTKPREEQFNSTYRVVSVLTVLHQDWLNGKEYKCKVSNKGLPSSIEKTISKAKGQPR EPQVYTLPPSQEEMTKNQVSLTCLVKGFYPSDIAVEWESNGQPENNYKTTPPVLDSDG SFFLYSRLTVDKSRWQEGNVFSCSVMHEALHNHYTQKSLSLSLGK |
| 211 | NORI-015 | Full heavy chain sequence | Nucleic acid sequence heavy chain | GAGGTGCAGCTGGTTGAAATCTGGCGGAGGACTGATCCAGGCCGGCAGATCTCTGAGAC TGTCTTGTGCCGCCTCCGGCTTCACCTTCGATGAGCACGTGATCTACTGGGTCCGACA GATCCCTGGCAAAGGCCTGGAATGGATCTCTCCATCTCCTGGAAGTCCGACATCATT GCCTACGCCGACTCCGTGAAGGGCAGATTCACCATCTCCAGAGACAACGCCAAGAACG CCCTGTACCTGCAGATGAACTCCCTGAGAGCCGAGGACACCGCTCTGTACTACTGCGC CAGAGAGAAGGACGGCGACTTTACTACTACTATTTCGCCATGGACGTGTGGGGCCAG |

-continued

| SEQ ID NO | | Description | Sequence |
|---|---|---|---|
| | | | GGCACCACAGTGACAGTTTCTTCTGCCAGCACCAAGGGCCCTTCCGTGTTCCCCCTGG |
| | | | CCCCTTGCAGCAGGAGCACCTCCGAATCCACAGCTGCCCTGGGCTGTCTGGTGAAGGA |
| | | | CTACTTTCCCGAGCCCGTGACCGTGAGCTGGAACAGCGGCGCTCTGACCATCCGGCGTC |
| | | | CACACCTTTCCTGCCGTCCTGCAGTCCTCCCGGCCTTCACTCCCTGTCCTCCGTGGTGA |
| | | | CCGTGCCTAGCTCCTCCCTGCGGCACCAAGACCTACACCTGTAACGTGGACCACAAACC |
| | | | CTCCAACACCAAGGTGGACAAACGGGTCGAGAGCAAGTACGGCCCTCCCTGTCCCTCCT |
| | | | TGTCCTGCCCCCCGAGTTGAAGGCGGACCACCAGCGTGTTCCTCTGTTCCCTCCTAAGCCA |
| | | | AGGAGCACCCTCATGATCAGCCGGACACCCGAGGTGACCTGCGTGGTGGTGGATGTGAG |
| | | | CCAGGAGGACCCTGAGGTCCAGTTCAACTGGTATGTGGATGGCGTGGAGGTGCACAAC |
| | | | GCCAAGACAAAGCCCCGGGAAGAGCAGTTCAACTCCACCTACAGGGTGGTCAGCGTGC |
| | | | TGACCGTGCTGCATCAGGACTGGCTGAACGGCAAGGAGTACAAGTGCAAGGTCAGCAA |
| | | | TAAGGACTGGCCTGTACACCCTGCCTCCCATCCCGAAGGCCAGGATCCCCGG |
| | | | GAACCTCAGGTGTACACCCTGCCTCCCTCCCGGGAGGAGATGACCAAGAACCAGGTGA |
| | | | GCCTGACCTGCCTGGTGAAAGGCTTCTACCCTTCCGACATCGCCGTGGAGTGGGAGTC |
| | | | TCCTTCTTTCTGTATCCTCCAGGCTGACCGTGGATAAGTCCAGGTGGCAGGAGGCAACG |
| | | | TGTTCAGCTGCTCTGTGATGCACGAGGCCCTGCACAATCACTACACCCAGAAGTCCCT |
| | | | GAGCCTGTCCCTGGGAAAG |
| 212 | NORI-015 | CDRL1 (IMGT) | Amino acid sequence of CDRL1 using IMGT | SSNVGYYNY |
| 213 | NORI-015 | CDRL2 (IMGT) | Amino acid sequence of CDRL2 using IMGT | EVN |
| 148 | NORI-015 | CDRL3 (IMGT) | Amino acid sequence of CDRL3 using IMGT | SSYAGSNKW |
| 214 | NORI-015 | CDRL1 (KABAT) | Amino acid sequence of CDRL1 using KABAT | TGTSSNVGYYNYVS |
| 215 | NORI-015 | CDRL2 (KABAT) | Amino acid sequence of CDRL2 using KABAT | EVNKRPS |
| 148 | NORI-015 | CDRL3 (KABAT) | Amino acid sequence of CDRL3 using KABAT | SSYAGSNKW |
| 216 | NORI-015 | Light chain variable region | Amino acid sequence of VL | QSALTQPPSASGSPGQSVTISCTGTSSNVGYYNYVSWYQQHPGKAPKLMIYEVNKRPS GVPDRFSGSKSANTASLTVSGLQADDEADYYCSSYAGSNKVVFGGGTKLTVL |
| 217 | NORI-015 | Light chain variable region | Nucleic acid sequence of VL | CAGTCTGCTCTGACCCAGCCTCCTTCTGCTTCTGGCTCTCCTGGCCAGTCCGTGACCA TCTCTTGTACCGGCACCTCCTCCAACGTGGGCTACTACAACTACGTGTCCTGGTATCA GCAGCACCCCGGCAAGGCTCCCAAGCTGATGATCTACGAAGTGAACAAGCGGCCCTCT GGCGTGCCCGATAGATTCTCCGGATCCAAGTCCGCCAATACCGCCTCTCTGACCGTGT CTGGACTGCAGGTGATGACGAGGCCGACTACTACTGCTCTTCTTACGCCGGCTCCAA CAAGGTGGTGTTTGGCGGCGGAACAAAGCTGACCAGTGCTG |
| 218 | NORI-015 | Full light chain | Amino acid sequence light chain | QSALTQPPSASGSPGQSVTISCTGTSSNVGYYNYVSWYQQHPGKAPKLMIYEVNKRPS GVPDRFSGSKSANTASLTVSGLQADDEADYYCSSYAGSNKVVFGGGTKLTVLGQPKAA |

-continued

| SEQ ID NO | | | Description | Sequence |
|---|---|---|---|---|
| | | sequence | | PSVTLFPPSSEELQANKATLVCLISDFYPGAVTVAWKADSSPVKAGVETTTPSKQSNN KYAASSYLSLTPEQWKSHRSYSCQVTHEGSTVEKTVAPTECS |
| 219 | NORI-015 | Full light chain sequence | Nucleic acid sequence light chain | CAGTCTGCTCTGACCCAGGCCTCCTTCTGCTTCTGGCTCTCCTGGCCAGTCCGTGACCA TCTCTTGTACCGGCACCTCCTCCAACGTGGGCTACTACAACTACGTGTCCTGGTATCA GCAGCACCCCGGCAAGGCTCCCAAGCTGCTGATGATCTACGAAGTGAACAAGCGGCCCTCT GGCGTGCCCGATAGATTCTCCGGATCCAAGTCCGGCAATACCGCCTCTCTGACCGTGT CTGGACTGCAGGCTGATGACGAGGCCGACTACTACTGCTCCTCTTACGCCGGCTCCAA CAAGGTGGTGTTTGGCGGCGGAACAAAGCTGACAGTGCTGGGACAGCCAAAGCACC CCATCCGTAACTCTGTTCCCACCTAGTTCAGAGGAGCTTCAAGCAAACAAGCCACAC TTGTTTGCCTTATTAGTGATTTTTATCCCGGTGCCGTGACAGTTGCCTGGAAAGCTGA TAGTCTCACCAGTGAAAGCTGGCGTGGAGACAACCACCACCATCTAAACAAGCAATAAC AAGTATGTGCCAGCTCATATGTGAGTCTCACTCCAGAACAATGGAAGTCTCATCGGT CCTATAGCTGTCAAGTGACCCACGAGAGGCAGTACCCGTGCGAAGACCGTGCCACCAAC AGAGTGTAGC |
| 188 | NORI-016 | CDRH1 (IMGT) | Amino acid sequence of CDRH1 using IMGT | GFTFDEHV |
| 200 | NORI-016 | CDRH2 (IMGT) | Amino acid sequence of CDRH2 using IMGT | ITWKSDII |
| 190 | NORI-016 | CDRH3 (IMGT) | Amino acid sequence of CDRH3 using IMGT | AREKDGFYYYFAMDV |
| 201 | NORI-016 | CDRH1 (KABAT) | Amino acid sequence of CDRH1 using Kabat | EHVMY |
| 202 | NORI-016 | CDRH2 (KABAT) | Amino acid sequence of CDRH2 using Kabat | SITWKSDIIAYADSVKG |
| 193 | NORI-016 | CDRH3 (KABAT) | Amino acid sequence of CDRH3 using Kabat | EKDGDFYYYFAMDV |
| 203 | NORI-016 | Heavy chain variable region | Amino acid sequence of VH | EVQLVESGGGLIQAGRSLRLSCAASGFTFDEHVMYWVRQIPGKGLEWISSITWKSDII AYADSVKGRFTISRDNAKNALYLQMNSLRAEDTALYYCAREKDGDFYYYFAMDVWGQ GTTVTVSS |
| 220 | NORI-016 | Heavy chain variable region | Nucleic acid sequence of VH | GAGGTGCAGCTGGTTGAATCTGGCGGAGGACTGATCCAGGCCGGCAGATCCTCGAGAC TGTCTTGTGCCGCCTCCGGCTTCACCTTCGATGAGCACGTGATGTACTGGGTCCGACA GATCCCTGGCAAAGGCCTGGAATGGATCTCCTCCATCACCTGGAAGTCCGACATCATT GCCTACGCCGACTCCGTGAAGGGCAGATTCACCATCTCCAGAGACAACGCCAAGAACG CCCTGTACCTGCAGATGAACTCCCTGAGAGCCGAGGACACCGCCCTCTGTACTACTGCGC CAGAGAGAAGGACGGCGACTTTTACTACTACTATTTCGCCATGGACGTGTGGGGCCAG GGCACCACAGTGACAGTTTCTTCT |
| 221 | NORI-016 | Full heavy chain sequence | Amino acid sequence heavy chain | EVQLVESGGGLIQAGRSLRLSCAASGFTFDEHVMYWVRQIPGKGLEWISSITWKSDII AYADSVKGRFTISRDNAKNALYLQMNSLRAEDTALYYCAREKDGDFYYYFAMDVWGQ GTTVTVSSASTKGPSVFPLAPCSRSTSESTAALGCLVKDYFPEPVTVSWNSGALTSGV HTFPAVLQSSGLYSLSSVVTVPSSSLGTKTYTCNVDHKPSNTKVDKRVESKYGPPCPP |

-continued

| SEQ ID NO | | Description | Sequence |
|---|---|---|---|
| 222 | NORI-016 | Full heavy chain sequence | CPAPEFEGGPSVFLFPPKPKDTLMISRTPEVTCVVVDVSQEDPEVQFNWYVDGVEVHN AKTKPREEQFNSTYRVVSVLTVLHQDWLNGKEYKCKVSNKGLPSSIEKTISKAKGQPR EPQVYTLPPSQEEMTKNQVSLTCLVKGFYPSDIAVEWESNGQPENNYKTTPPVLDSDG SFFLYSRLTVDKSRWQEGNVFSCSVMHEALHNHYTQKSLSLSLGK |
| | | Nucleic acid sequence heavy chain | GAGGTGCAGCTGGTTGAATCTGGCGGAGGACTGATCCAGCCCGGCAGATCTCTGAGAC TGTCTTGTGCCGCCTCCGGTTCACCTTCGATGAGCACGTGATGTACTGGGTCCGACA GATCCCTGGCAAAGGCCTGGAATGGATCTCCTCCATCACCTGGAAGTCCGACATCATT GCCTACGCCGACTCCGTGAAGGGCAGATTCACCATCTCCAGAGACAACGCCAAGAACG CCCTGTACCTGCAGATGAACTCCCTGAGAGCCGAGGACACCGCTGTACTACTGCGC CAGAGAAGGACGGCGACTTTCTACTACTATTTCGCCATGGACGTGTGGGGCCAG GGCACCACAGTGACAGTTCTTCTGCCAGCACCAAGGGCCCTTCCGTGTTCCCCCTGG CCCCTTGCAGGAGCACCTCCGAATCCACAGCTGCCCTGGGCTGTCTGTGTGAAGGA CTACTTTCCCGAGCCCGTGACCGTGAGCTGGAACAGCGGCGCTTGACATCCGGCGTC CACACCTTCTGCCGTCCTGCAGTCCTCCGGCCTCTACTCCCTGTCCTCCGTGGTGA CCGTGCCTAGCTCCTCCCTGCGGTCGAGGACTACAAGTGCAAGGTCTCCAACAAACC CTCCAACACCAAGGTGGACAAACGGGTTCGAGAGCAAGGGCGACCCCTCCGTGCTCCT TGTCCTGCCCCCGAGTTCGAAGGCGGACCCCAGCGTGTTCCTGTTCCCTCCTAAGCCCA AGGACACCCTCATGATCAGCCGGACACCCGAGGTGACCTGCGTGGTGGTGATGTGAG CCAGGAGGACCCTGAGGTCCAGTTCAACTGGTATGTGGATGGCGTGGAGGTGCACAAC GCCAAGACAAAGCCCGGAGGAGCAGTTCAACTCCACCTACAGGGTGGTCAGCGTGC TGACCGTGCTGCTCATCAGGACTGGCTGAACGGCAAGGAGTACAAGTCCAAGGTCAGCAA TAAGGACTGCCAGGTGTACACCCTGCCTCCCAGCCAGGAGGATGACCAAGAACCAGGTGA GCCTGACCTGCCTGGTGAAGGATTCTACCCTTCCAGACATCGCCGTGGAGTGGGAGTC CAACGGCCAGCCCGAGAACAATTATAAGACCACCCCTCCCGTCCTCGACACGCGACGGA TCCTTCTTTCTGTACTCCAGGCTGACCGTGGATAAGTCCAGGTGGCAGGAAGGCAACG TGTTCAGCTGCTCCGTGATGCACGAGGCCCTGCACAATCACTACACCCAGAAGTCCCT GAGCCTGCTCCCTGGGAAAG |
| 212 | NORI-016 | CDRL1 (IMGT) | Amino acid sequence of CDRL1 using IMGT | SSNVGYYNY |
| 213 | NORI-016 | CDRL2 (IMGT) | Amino acid sequence of CDRL2 using IMGT | EVN |
| 148 | NORI-016 | CDRL3 (IMGT) | Amino acid sequence of CDRL3 using IMGT | SSYAGSNKW |
| 214 | NORI-016 | CDRL1 (KABAT) | Amino acid sequence of CDRL1 using KABAT | TGTSSNVGYYNYVS |
| 215 | NORI-016 | CDRL2 (KABAT) | Amino acid sequence of CDRL2 using KABAT | EVNKRPS |
| 148 | NORI-016 | CDRL3 (KABAT) | Amino acid sequence of CDRL3 using KABAT | SSYAGSNKW |

-continued

| SEQ ID NO | | Description | Sequence |
|---|---|---|---|
| 216 | NORI-016 | Light chain variable region | Amino acid sequence of VL | QSALTQPPSASGSPGQSVTISCTGTSSNVGYYNYVSWYQQHPGKAPKLMIYEVNKRPS GVPDRFSGSKSANTASLTVSGLQADDEADYYCSSYAGSNKVVFGGGTKLTVL |
| 223 | NORI-016 | Light chain variable region | Nucleic acid sequence of VL | CAGTCTGCTCTGACCCAGCCTCCTCTCTGCTCTGGCTCTCCTGGCCAGTCCGTGACCA TCTCTTGTACCGGCACCTCCTCCAACGTGGGCTACTACAACTACGTGTCCTGGTATCA GCAGCACCCCGGCAAGGCTCCCAAGCTGATGATCTACGAAGTGAACAAGCGGCCCTCT GGCGTGCCCGATAGATTCTCCGGATCCAAGTCCGCCAATACCGCCTCTCTGACCGTGT CTGGACTGCAGGCTGATGACGAGGCCGACTACTACTGCTCCTCCTACGCCGGCTCCAA CAAGGTGGTGTTTGGCGGCGGAACAAAGCTGACAGTGCTG |
| 218 | NORI-016 | Full light chain sequence | Amino acid sequence light chain | QSALTQPPSASGSPGQSVTISCTGTSSNVGYYNYVSWYQQHPGKAPKLMIYEVNKRPS GVPDRFSGSKSANTASLTVSGLQADDEADYYCSSYAGSNKVVFGGGTKLTVLGQPKAA PSVTLFPPSSEELQANKATLVCLISDFYPGAVTVAWKADSSPVKAGVETTTPSKQSNN KYAASSYLSLTPEQWKSHRSYSCQVTHEGSTVEKTVAPTECS |
| 224 | NORI-016 | Full light chain sequence | Nucleic acid sequence light chain | CAGTCTGCTCTGACCCAGCCTCCTCTCTGCTCTGGCTCTCCTGGCCAGTCCGTGACCA TCTCTTGTACCGGCACCTCCTCCAACGTGGGCTACTACAACTACGTGTCCTGGTATCA GCAGCACCCCGGCAAGGCTCCCAAGCTGATGATCTACGAAGTGAACAAGCGGCCCTCT GGCGTGCCCGATAGATTCTCCGGATCCAAGTCCGCCAATACCGCCTCTCTGACCGTGT CTGGACTGCAGGCTGATGACGAGGCCGACTACTACTGCTCCTCCTACGCCGGCTCCAA CAAGGTGGTGTTTGGCGGCGGAACAAAGCTGACAGTGCTGGGACAGCCCAAAGCAGCC CCATCCGTAACTCTGTTCCCACCTAGTTCAGAGGAGCTTCAAGCAAACAAAGCCACAC TTGTTTGCCTTATTAGTGATTTTTATCCCGGTGCCGTGACAGTTGCCTGGAAAGCTGA TAGCTCACCAGTGAAAGCTGGCGTGGAGACAACCACCACCATCTAAACAAAGCAATAAC AAGTATTGTGCCAGCTCATATGTGAGTCTACTCCAGAACAATGGAGTCTCATCGGT CCTAGCTGTCAAGTGACCCACGAAGGCAGTACCGTGGAAGACCGTGGCACCAAC AGAGTGTAGC |
| 225 | NORI-017 | | Amino acid sequence of CDRH1 (IMGT) | GFTFSNFD |
| 226 | NORI-017 | | Amino acid sequence of CDRH2 (IMGT) | IRYDETNI |
| 227 | NORI-017 | | Amino acid sequence of CDRH3 (IMGT) | ARGWTGSYVFDY |
| 228 | NORI-017 | | Amino acid sequence of CDRH1 (KABAT) | NFDMH |
| 229 | NORI-017 | | Amino acid sequence of CDRH2 (KABAT) | IIRYDETNIYYTESVRG |
| 230 | NORI-017 | | Amino acid sequence of CDRH3 (KABAT) | GWTGSYVFDY |
| 231 | NORI-017 | Heavy chain variable region | Amino acid sequence of VH | QVHLVESGGAVVQPGRSLRLSCAASGFTFSNFDMHWVRQTPGKGLEWVTIIRYDETNI YYTESVRGRFTTSRDNSRNTLYLQMNSLRVEDTAVYYCARGWTGSYVFDYWGQGALVT VSS |

| SEQ ID NO | | Description | Sequence |
|---|---|---|---|
| 232 | NORI-017 | Heavy chain variable region | Nucleic acid sequence of VH | CAGGTGCACCTGGTGGAGTCTGGGGGAGGCCGTGGTCCAGCCTGGGAGGTCCCTGAGAC<br>TCTCCTGTGCAGCGTCTGGATTCACCTTCAGTAACTTTGACCATGCACTGGGTCCGCCA<br>GACTCCAGGCAAGGGGCTGGAGTGGGTGGCAGTTATTATTCGGTATGATGAAACTAATA<br>TACTATATACAGAGTCCGTGAAGGGCCGTTTCACCACCTCCAGAGACAATTCCAAGAACA<br>CACTGTATCTGCAAATGAACAGCCTGCGAGTCGAGACACCGCTGTGTATTACTGTGC<br>GAGAGGTGGACTGGAGTTATGTCTTTGACTACTGGGGCCAGGGAGCCCTGGTCACC<br>GTCTCCTCA |
| 233 | NORI-017 | Full heavy chain sequence | Amino acid sequence heavy chain | QVHLVESGGAVVQPGRSLRLSCAASGFTFSNFDMHWVRQTPGKGLEWVTIIRYDETNI<br>YYTESVRGRFTTSRDNSRNTLYLQMNSLRVEDTAVYYCARGWTGSYVFDYWGQGALVT<br>VSSASTRGPSVFPLAPCSRSTSESTAALGCLVRDYFPEPVTVSWNSGALTSGVHTFPA<br>VLQSSGLYSLSSVVTVPSSSLGTKTYTCNVDHKPSNTKVDKRVESKYGPPCPPCPAPE<br>FEGGPSVFLFPPKPKDTLMISRTPEVTCVVVDVSQEDPEVQFNWYVDGVEVHNAKTKP<br>REEQFNSTYRVVSVLTVLHQDWLNGREYRCRVSNRGLPSSIERTISRARQQPREPQVY<br>TLPPSQEEMTKNQVSLTCLVKGFYPSDIAVEWESNGQPENNYKTTPPVLDSDGSFFLY<br>SRLTVDRSRWQEGNVFSCSVMHEALHNHYTQRSLSLSLGR |
| 234 | NORI-017 | Full heavy chain sequence | Nucleic acid sequence heavy chain | CAGGTGCACCTGGTGGAGTCTGGGGGAGGCCGTGGTCCAGCCTGGGAGGTCCCTGAGAC<br>TCTCCTGTGCAGCGTCTGGATTCACCTTCAGTAACTTTGACCATGCACTGGGTCCGCCA<br>GACTCCAGGCAAGGGGCTGGAGTGGGTGGCAGTTATTATTCGGTATGATGAAACTAATA<br>TACTATATACAGAGTCCGTGAAGGGCCGTTTCACCACCTCCAGAGACAATTCCAAGAACA<br>CACTGTATCTGCAAATGAACAGCCTGCGAGTCGAGACACCGCTGTGTATTACTGTGC<br>GAGAGGTGGACTGGAGTTATGTCTTTGACTACTGGGGCCAGGGAGCCCTGGTCACC<br>GTCTCCTCAGCGACCACCAAGGGCCCTCAGTCTTCCCCCTGGCACCCTCCTCCAAGAGC<br>GCACCTCCGAATCCAGCTGCGAACAGCGGCGCCTCGACATCCGGCGTCCACACCTTTCTGCC<br>CGTGACCGTGAGCTGGAACTCAGGCGCCCTGACCAGCGGCGTGCACACCTTCCCAGCTGTCCT<br>CCCTCGGCCACCAAGACCTACACCTGTAACGTGGACCACAAACCCTCCAACACCAAGGT<br>GGACAAACGGGTCGAGAGCAAGTACGGCCCCCTCCCGCCCCTGCCCCTCCTGTCCCCAG<br>TTCGAAGGCGGACACCGAGGTGACCTGCGTGGTGGTGGATGTGAGCCAGGAGGACCCTGA<br>GGTCCAGTTCAACTGGTATGTGGATGGCGTGGAGGTGCACAACGCCAAGACAAAGCCC<br>CGGGAAGAGCAGTTCAACTCCACCTACAGGGTGGTCAGCGTGCTGACCGTGCTGCATC<br>AGGACTGGCTGAACGGCAAGGAGTACAAGTGCAAGGTCAGCAATAAGGGACTGCCCAG<br>CAGCATCGAGAGAACCATCTCCAAGGCTAAAGGCCAGCCCCGGGAACCTCAGGTGTAC<br>ACCCTGCCTCCCAGGAGGAGATGACCAAGAACCAGGTGAGCCTGACCTGCCTGG<br>TGAAGGGATTCTACCCTTCCGACATCGCCGTGGAGTGGAGTCCAACGGCCAGCCCGA<br>GAACAATTATAAGACCACCCCTCCCGTCCTCGACAGCGACGGCATCCTTCTTTCTGTAC<br>TCCAGGCTGACCGTGGATAAGTCCAGGTGGCAGGAAGGCAACGTGTTCAGCTGCTCCG<br>TGATGCACGAGGCCCTGCACAATCACTACACCCAGAGTCCCTGAGCCCTGTCCCTGGG<br>AAAG |
| 235 | NORI-017 | CDRL1 (IMGT) | Amino acid sequence of CDRL1 using IMGT | SSNIGNNA |
| 236 | NORI-017 | CDRL2 (IMGT) | Amino acid sequence of CDRL2 using IMGT | YDD |

-continued

| SEQ ID NO | | | Description | Sequence |
|---|---|---|---|---|
| 237 | NORI-017 | CDRL3 (IMGT) | Amino acid sequence of CDRL3 using IMGT | AAWDDSLNGVV |
| 238 | NORI-017 | CDRL1 (KABAT) | Amino acid sequence of CDRL1 using KABAT | SGGSSNIGNNAVN |
| 239 | NORI-017 | CDRL2 (KABAT) | Amino acid sequence of CDRL2 using KABAT | YDDLLPS |
| 237 | NORI-017 | CDRL3 (KABAT) | Amino acid sequence of CDRL3 using KABAT | AAWDDSLNGVV |
| 240 | NORI-017 | Light chain variable region | Amino acid sequence of VL | QSVLTQPPSVSEAPRQRVTISCSGGSSNIGNNAVNWYQQVPGKAPKLLIHYDDLLPSG VSDRFSGSKSGTSASLAISGLQSEDEADYCAAWDDSLNGVVFGGGTKLTVL |
| 241 | NORI-017 | Light chain variable region | Nucleic acid sequence of VL | CAGTCTGTGCTGACTCAGCCACCCTCGGTGTCTGAAGCCCCCAGGCAGAGGGTCACCA TCTCCTGTTCTGGAGGCAGTTCCAACATCGGAAATAATGCTGTAAACTGGTACCAGCA GGTCCCAGGAAAGGCTCCAAAACTCCTCATCCATTATGATGATCTACTGCCCTCAGGG GTCTCTGACCGATTCTCTGGCTCCAAGTCTGGCACCTCAGCCTCCCTGGCCATCAGTG GACTCCAGTCTGAGGATGAGGCTGATTATTACTGTGCAGCAGGATGACAGCCTGAA TGGTGTGGTATTCGGCGGAGGTACCAAGCTGACCGTCCTA |
| 242 | NORI-017 | Full light chain sequence | Amino acid sequence light chain | QSVLTQPPSVSEAPRQRVTISCSGGSSNIGNNAVNWYQQVPGKAPKLLIHYDDLLPSG VSDRFSGSKSGTSASLAISGLQSEDEADYCAAWDDSLNGVVFGGGTKLTVLGQPKAA PSVTLFPPSSEELQANKATLVCLISDFYPGAVTVAWKADSSPVKAGVETTTPSKQSNN KYAASSYLSLTPEQWKSHRSYSCQVTHEGSTVEKTVAPTECS |
| 243 | NORI-017 | Full light chain sequence | Nucleic acid sequence light chain | CAGTCTGTGCTGACTCAGCCACCCTCGGTGTCTGAAGCCCCCAGGCAGAGGGTCACCA TCTCCTGTTCTGGAGGCAGTTCCAACATCGGAAATAATGCTGTAAACTGGTACCAGCA GGTCCCAGGAAAGGCTCCAAAACTCCTCATCCATTATGATGATCTACTGCCCTCAGGG GTCTCTGACCGATTCTCTGGCTCCAAGTCTGGCACCTCAGCCTCCCTGGCCATCAGTG GACTCCAGTCTGAGGATGAGGCTGATTATTACTGTGCAGCAGGATGACAGCCTGAA TGGTGTGGTATTCGGCGGAGGTACCAAGCTGACCGTCCTAGGACAGCCCAAAGCAGCC CCATCCGTAACTCTGTTCCCACCCTCTTCCGAGGAGCTTCAAGCAAACAAAGCCACAC TTGTTTGCCTTATTAGTGATTTTTATCCCGGTGCCGTGACAGTTGCCTGGAAAGCTGA TAGCTCACCAGTGAAAGCTGGCGTGGAGACAACCACACCATCTAAACAAAGCAATAAC AAGTATGTGCCAGCTCATATGTGAGTCTCACTCCAGAACAATGGAAGTCTCATCGGT CCTATAGCTGTCAAGTGACCCACGAAGGCAGTACCCGTCGAGAAGACACCGTGGCACCCAAC AGAGTGTAGC |
| 244 | NORI-018 | CDRH1 (IMGT) | Amino acid sequence of CDRH1 using IMGT | GYTFTTFG |
| 245 | NORI-018 | CDRH2 (IMGT) | Amino acid sequence of CDRH2 using IMGT | ISGYNGNT |
| 246 | NORI-018 | CDRH3 (IMGT) | Amino acid sequence of CDRH3 using IMGT | ARDRAIAPRFDP |

-continued

| SEQ ID NO | | Description | Sequence |
|---|---|---|---|
| 247 | NORI-018 CDRH1 (KABAT) | Amino acid sequence of CDRH1 using Kabat | TFGIV |
| 248 | NORI-018 CDRH2 (KABAT) | Amino acid sequence of CDRH2 using Kabat | WISGYNGNTKYAQNLQG |
| 249 | NORI-018 CDRH3 (KABAT) | Amino acid sequence of CDRH3 using Kabat | DRAIAPRFDP |
| 250 | NORI-018 Heavy chain variable region | Amino acid sequence of VH | QLQLVQSGAEVKKPGASVKVSCKASGYTFTFGIVWVRQAPGQGLEWMGWISGYNGNT KYAQNLQGRVTMTTDTSTSTAYMELRSLRSDDTAIYYCARDRAIAPRFDPWGQGTLVT VSS |
| 251 | NORI-018 Heavy chain variable region | Nucleic acid sequence of VH | CAGCTTCAGCTGGTGCAGTCTGGAGCTGAGGTGAAGAAGCCTGGGGCCTCAGTGAAGG TCTCCTGCAAGGCTTCTGGTTACACCTTTACCGTGCTATCGTCTGGGTGCGACA GGCCCCTGGACAAGGGCTTGAGTGATGGGATGGGATCAGCCGGTTACAATGTAACACA AAGTATGCACAGAAATCTCAGGGCACCAGTCACCACACACAATCCACGAGACA CAGCCTACACTGGAACTGAGGAGCCTGAGATCTGACGACACGGCCATATATTACTGTGC GAGAGATAGGGCTATAGCACCTGGTTCGACCCCTGGGGCCAGGGAACCCTGGTCACC GTCTCCTCA |
| 252 | NORI-018 Full heavy chain sequence | Amino acid sequence heavy chain | QLQLVQSGAEVKKPGASVKVSCKASGYTFTFGIVWVRQAPGQGLEWMGWISGYNGNT KYAQNLQGRVTMTTDTSTSTAYMELRSLRSDDTAIYYCARDRAIAPRFDPWGQGTLVT VSSASTKGPSVFPLAPCSRSTSESTAALGCLVKDYFPEPVTVSWNSGALTSGVHTFPA VLQSSGLYSLSSVVTVPSSSLGTKTYTCNVDHKPSNTKVDKRVESKYGPPCPPCPAPE FEGGPSVFLFPPKPKDTLMISRTPEVTCVVVDVSQEDPEVQFNWYVDGVEVHNAKTKP REEQFNSTYRVVSVLTVLHQDWLNGKEYKCKVSNKGLPSSIEKTISKAKGQPREPQVY TLPPSQEEMTKNQVSLTCLVKGFYPSDIAVEWESNGQPENNYKTTPPVLDSDGSFFLY SRLTVDKSRWQEGNVFSCSVMHEALHNHYTQKSLSLSLGK |
| 253 | NORI-018 Full heavy chain sequence | Nucleic acid sequence heavy chain | CAGCTTCAGCTGGTGCAGTCTGGAGCTGAGGTGAAGAAGCCTGGGGCCTCAGTGAAGG TCTCCTGCAAGGCTTCTGGTTACACCTTTACCGTGCTATCGTCTGGGTGCGACA GGCCCCTGGACAAGGGCTTGAGTGATGGGATGGGATCAGCCGGTTACAATGTAACACA AAGTATGCACAGAAATCTCAGGGCACCAGTCACCACACACAATCCACGAGACA CAGCCTACACTGGAACTGAGGAGCCTGAGATCTGACGACACGGCCATATATTACTGTGC GTCTCCTCAGCCGAGACCACCAAGGGCCCTTCCGGTCCCCTGGCCCCTGCACCAGGA GCACCTCCGAATCCACAGCTGCCCTGGTGCTGTGGTGAAGGACTACTTTCCGAGCC CGTGACCGTGAGCTGGAACAGCGGCGCCCTACTCCGGTCTCCGTGGTGACCGTGCCT CCCTCGGCCACCAAGACCTACACCTGTAACGTGGACCACAAACCCTCCAACACCAAGGT GGACAAACGGGTCGAGAGCAAGTACGGCCCCCCGTGCCCCTCCTTGTCCTGCCCCCGAG TTCGAAGGCGGACACCCGAGGTGACCTGCGTGGTGGTGATGTGAGCCAGGAGGACCCTGA GGTCCAGTTCAACTGGTATGTGGATGGCGTGGAGGTGCACAACGCCAAGACCC CGGGAGAGCAGTTCAACTCCACCTACAGGTGGTCAGCGTGCTGACCGTGCTGCATC AGGACTGGCTGAACGGCAAGGAGTACAAGTGCAAGGTCAGCAATAAGGGACTGCCCAG CAGCATCGAGAAGACCATCTCCAAGGCTAAAGGCCAGCCCCGGGAACCTCAGGTGTAC ACCCTGCCTCCCAGCCAGGAGGAGATGACCAAGAACCAGGTGAGCCTGACCTGCCTGG TGAAGGGATTCTACCCTTCCGACATCGCCGTGGAGTGGGAGTCCAACGGCCAGCCCGA |

-continued

| SEQ ID NO | | Description | Sequence |
|---|---|---|---|
| | | | GAACAATTATAAGACCACCCCTCCCGTCCTCTGACAGCGACGGATCCTTCTTTCTGTAC TCCAGGCTGACCGTGGATAAGTCCAGGTGGCAGGAAGGCAACGTGTTCAGCTGCTCCG TGATGCACGAGGCCCTGCACAATCACTACACCCAGAGAGTCCCTGAGCCTGTCCCTGGG AAAG |
| 254 | NORI-018 | CDRL1 (IMGT) | Amino acid sequence of CDRL1 using IMGT | NLGDNF |
| 255 | NORI-018 | CDRL2 (IMGT) | Amino acid sequence of CDRL2 using IMGT | QDS |
| 256 | NORI-018 | CDRL3 (IMGT) | Amino acid sequence of CDRL3 using IMGT | QAWDSSTW |
| 257 | NORI-018 | CDRL1 (KABAT) | Amino acid sequence of CDRL1 using KABAT | SGDNLGDNFAC |
| 258 | NORI-018 | CDRL2 (KABAT) | Amino acid sequence of CDRL2 using KABAT | QDSKRPS |
| 256 | NORI-018 | CDRL3 (KABAT) | Amino acid sequence of CDRL3 using KABAT | QAWDSSTW |
| 259 | NORI-018 | Light chain variable region | Amino acid sequence of VL | SYELTQPPSVSVSPGQAASIPCSGDNLGDNFACWYQQKPGQSPVLVIYQDSKRPSGIP ERFSGSNSGNTATLTINGTQAMDEADYYCQAWDSSTWFGGGTKLTVL |
| 260 | NORI-018 | Light chain variable region | Nucleic acid sequence of VL | TCCTATGAGCTGACTCAGCCACCCTCCAGTGTCCGTGTCCCCAGGACAGGCAGCCAGCA TCCCCTGCTCTGGAGATAATTTGGGGGATAACTTTGCTTGCTGGTATCAGCAGAAGCC AGGCCAGTCTCCTGTCGTGTTGGTCATCTATCAAGATAGCAAGCGCCCTCAGGGATCCT GAGCGATTCTCTGGCTCCAACTCTGGGAACACAGCCACTCTGACCATCAACGGGACCC AGGCTATGGACGAGGCTGACTATTACTGTCAGGCGTGGGACAGCAGCACTGTGGTATT CGGCCGAGGGACCAAGCTGACCGTCCTA |
| 261 | NORI-018 | Full light chain sequence | Amino acid sequence light chain | SYELTQPPSVSVSPGQAASIPCSGDNLGDNFACWYQQKPGQSPVLVIYQDSKRPSGIP ERFSGSNSGNTATLTINGTQAMDEADYYCQAWDSSTVVFGGGTKLTVLGQPKAAPSVT LFPPSSEELQANKATLVCLISDFYPGAVTVAWKADSSPVKAGVETTTPSIKQSNNKYAA SSYLSLTPEQWKSHRSYSCQVTHEGSTVEKTVAPTECS |
| 262 | NORI-018 | Full light chain sequence | Nucleic acid sequence light chain | TCCTATGAGCTGACTCAGCCACCCTCCAGTGTCCGTGTCCCCAGGACAGGCAGCCAGCA TCCCCTGCTCTGGAGATAATTTGGGGGATAACTTTGCTTGCTGGTATCAGCAGAAGCC AGGCCAGTCTCCTGTCGTGTTGGTCATCTATCAAGATAGCAAGCGCCCTCAGGGATCCT GAGCGATTCTCTGGCTCCAACTCTGGGAACACAGCCACTCTGACCATCAACGGGACCC AGGCTATGGACGAGGCTGACTATTACTGTCAGGCGTGGGACAGCAGCACTGTGGTATT CGGCCGAGGGACCAAGCTGACCGTCCTA CGTGTTCCCACCAGTTCAGGAGGAGCTTCAAGCAAACAAAGCCACACTTGTTTGCCTTA TTAGTGATTTTTATCCCGGTGCCGTGACAGTTGCCTGGAAGGCTGATAGCTCACCAGT GAAAGCTGGCGTGGAGACAACCACCACCATCTAAACAAAGCAATAACAAGTATGGTGCC AGCTCATATCTGAGTCTCACTCCAGAACAATGGAAGTCTCATCGGTCCTATAGCTGTC AAGTGACCCCACGAAGGCAGTACCGTCGAGAGACCGTGGAGAAGACCGTGGCCAACAGAGTGTAGC |

| SEQ ID NO | | Description | Sequence |
|---|---|---|---|
| 225 | NORI-019 | CDRH1 (IMGT) | Amino acid sequence of CDRH1 using IMGT | GFTFSNFD |
| 263 | NORI-019 | CDRH2 (IMGT) | Amino acid sequence of CDRH2 using IMGT | ISYDGSDK |
| 264 | NORI-019 | CDRH3 (IMGT) | Amino acid sequence of CDRH3 using IMGT | AKDGYGSSLFDH |
| 228 | NORI-019 | CDRH1 (KABAT) | Amino acid sequence of CDRH1 using Kabat | NFDMH |
| 265 | NORI-019 | CDRH2 (KABAT) | Amino acid sequence of CDRH2 using Kabat | IISYDGSDKYYEDSVKG |
| 266 | NORI-019 | CDRH3 (KABAT) | Amino acid sequence of CDRH3 using Kabat | DGYGSSLFDH |
| 267 | NORI-019 | Heavy chain variable region | Amino acid sequence of VH | QVQLVESGGGVVQPGRSLRLSCAASGFTFSNFDMHWVRQAPGKGLEWVAIISYDGSDK YYEDSVKGRFTISRDNSKNTLYLQMNSLRAEDTAIYYCAKDGYGSSLFDHWGQGTLVT VSS |
| 268 | NORI-019 | Heavy chain variable region | Nucleic acid sequence of VH | CAGGTGCAGCTGGTGGAGTCTGGGGGAGGCGTGGTCCAGCCTGGGAGGTCCCTGAGAC TCTCCTGTGCAGCCTCGGGATTCACCTTCAGTAACTTTGACATGCACTGGGTCCGCCA GGCTCCAGGCAAGGGGCTGGAGTGGGTGGCAATTATATCATATGATGGAAGTGATAAA TATTATGAAGACTCCGTGAAGGGCCGATTCACCATCTCCAGAGACAATTCCAAAACA CGCTGTATCTGCAAATGAACAGCCTGAGAGCTGAGGACACAGGCTATTTATTATTGTGC GAAAGATGGGTATGGCAGTTCCCTCTTTGACCACTGGGGCCAGGGAACCCTGGTCACC GTCTCCTCA |
| 269 | NORI-019 | Full heavy chain sequence | Amino acid sequence heavy chain | QVQLVESGGGVVQPGRSLRLSCAASGFTFSNFDMHWVRQAPGKGLEWVAIISYDGSDK YYEDSVKGRFTISRDNSKNTLYLQMNSLRAEDTAIYYCAKDGYGSSLFDHWGQGTLVT VSSASTKGPSVFPLAPCSRSTSESTAALGCLVKDYFPEPVTVSWNSGALTSGVHTFPA VLQSSGLYSLSSVVTVPSSSLGTKTYTCNVDHKPSNTKVDKRVESKYGPPCPPCPAPE FEGGPSVFLFPPKPKDTLMISRTPEVTCVVVDVSQEDPEVQFNWYVDGVEVHNAKTKP REEQFNSTYRVVSVLTVLHQDWLNGKEYKCKVSNKGLPSSIEKTISKAKGQPREPQVY TLPPSQEEMTKNQVSLTCLVKGFYPSDIAVEWESNGQPENNYKTTPPVLDSDGSFFLY SRLTVDKSRWQEGNVFSCSVMHEALHNHYTQKSLSLSLGK |
| 270 | NORI-019 | Full heavy chain sequence | Nucleic acid sequence heavy chain | CAGGTGCAGCTGGTGGAGTCTGGGGGAGGCGTGGTCCAGCCTGGGAGGTCCCTGAGAC TCTCCTGTGCAGCCTCGGGATTCACCTTCAGTAACTTTGACATGCACTGGGTCCGCCA GGCTCCAGGCAAGGGGCTGGAGTGGGTGGCAATTATATCATATGATGGAAGTGATAAA TATTATGAAGACTCCGTGAAGGGCCGATTCACCATCTCCAGAGACAATTCCAAAACA CGCTGTATCTGCAAATGAACAGCCTGAGAGCTGAGGACACAGGCTATTTATTATTGTGC GAAAGATGGGTATGGCAGTTCCCTCTTTGACCACTGGGGCCAGGGAACCCTGGTCACC GTCTCCTCAGCCACCAAGGGCCCATCGGTCTTCCCCCTGGCGCCCTGCTCCAGGAGCA GCACCTCCGAATCCGGAGCTGAGCTGGAACAGCGGCGCTGACCATCCGGCGTCCAGCC CGTGACCGTGAGCTGGAACTCCGGCGCCCTCACTCCCGTAGTCCT GTCCTGCAGTCCTCCCGGCCCTCTACTCCCTGTCCTCCGTGGTGACCGTGCCCTAGCTCCT |

-continued

| SEQ ID NO | | Description | Sequence |
|---|---|---|---|
| | | | CCCTCGCCACCAAGACCTACACCTGTAACGTGGACCACAAACCCTCCAACACCAAGGT |
| | | | GGACAAACGGGTGCGAGCAGCAAGTACGGCCTCCCGTGCCCTCCTTGTCCTCCTGCCCCCGAG |
| | | | TTCGAAGGCCGGACCCCAGCGTGTTCCTGTTCCCTCCTAAGCCCAAGGACACACCCTCATGA |
| | | | TCAGCCGGACACCCGAGGTGACCTGCGTGGTGGTGGATGTGAGCCAGGAGGACCCTGA |
| | | | GGTCCAGTTCAACTGGTATGTGGATGGCGTGGAGGTGCACAATGCCAAGACAAAGCCC |
| | | | CGGGAAGAGCAGTTCAACTCCACCTACAGGGTGGTCAGCGTGCTGCTGACCGTGCTGCATC |
| | | | AGGACTGGCTGAACGGCAAGGAGTACAAGTGCAAGGTCAGCAATAAGGGACTGCCCAG |
| | | | CAGCATCGAGAAGACCATCTCCAAGGCTAAAGGCCAGCCCCGGGAACCTCAGGTGTAC |
| | | | ACCCTGCCTCCCAGCCAGGAGGAGATGACCAAGAACCAGGTGAGCCTGACCTGCCTGG |
| | | | TGAAGGGATTCTACCCTCCGACATCGCCGTGGAGTGGGAGTCCAACGGCCAGCCCGA |
| | | | GAACAATTATAAGACCACCCCTCCCGTGCTGGACAGCGACGGATCCTTCTTTCTGTAC |
| | | | TCCAGGCTGACCGTGGATAAGTCCAGGTGGCAGGAGGGCAACGTGTTCAGCTGCTCCG |
| | | | TGATGCACGAGGCCCTGCACAATCACTACACCCAGAAGTCCCTGAGCCTGTCCCTGGG |
| | | | AAAG |
| 235 | NORI-019 CDRL1 (IMGT) | Amino acid sequence of CDRL1 using IMGT | SSNIGNNA |
| 236 | NORI-019 CDRL2 (IMGT) | Amino acid sequence of CDRL2 using IMGT | YDD |
| 271 | NORI-019 CDRL3 (IMGT) | Amino acid sequence of CDRL3 using IMGT | AVWDDSLNGVL |
| 272 | NORI-019 CDRL1 (KABAT) | Amino acid sequence of CDRL1 using KABAT | SGSSSNIGNNAVN |
| 239 | NORI-019 CDRL2 (KABAT) | Amino acid sequence of CDRL2 using KABAT | YDDLLPS |
| 271 | NORI-019 CDRL3 (KABAT) | Amino acid sequence of CDRL3 using KABAT | AVWDDSLNGVL |
| 273 | NORI-019 Light chain variable region | Amino acid sequence of VL | QSVLTQPPSVSEAPRQRVTISCSGSSSNIGNNAVNWFQQLPGEVPKLLIYDDLLPSG VSDRFSGSKSGTSASLAISGLQSEDEADYYCAVWDDSLNGVLFGGGTKLTVL |
| 274 | NORI-019 Light chain variable region | Nucleic acid sequence of VL | CAGTCTGTGCTGACTCAGCCACCCTCGGTGTCTGAAGCCCCCAGGCAGAGGGTCACCA TCTCCTGTTCTGGAAGCAGCTCCAACATCGGAAATAATGCTGTAAACTGGTTCCAGCA GCTCCCAGGAGGAGGTTCCCAAACTCCTCATCTATTATGATGATCTGCGCCCTCAGGA GTCTCTGACCGATTCTCTGGCTCCAAGTCTGGCACCTCAGCCTCCCTGGCCATCAGTG GGCTCCAGTCTGAGGATGAGGCTGATTATTACTGTGCAGTTTGGGATGACAGCCTGAA TGGTGTCCTATTCGGCGGAGGGACCAAGCTGACCGTCCTA |
| 275 | NORI-019 Full light chain sequence | Amino acid sequence light chain | QSVLTQPPSVSEAPRQRVTISCSGSSSNIGNNAVNWFQQLPGEVPKLLIYDDLLPSG VSDRFSGSKSGTSASLAISGLQSEDEADYYCAVWDDSLNGVLFGGGTKLTVLGQPKAA PSVTLFPPSSEELQANKATLVCLISDFYPGAVTVAWKADSSPVKAGVETTTPSKQSNN KYAASSYLSLTPEQWKSHRSYSCQVTHEGSTVEKTVAPTECS |

-continued

| SEQ ID NO | | Description | Sequence |
|---|---|---|---|
| 276 | NORI-019 | Full light chain sequence | Nucleic acid sequence light chain | CAGTCTGTGCTGACTCAGCCACCCTCGGTGTCTGAAGCCCCCAGGCAGAGGGTCACCA TCTCCTGTTCTGGAAGCAGCTCCAACATCGGAAGTAAATGTGTAAACTGGTTCCAGCA GCTCCCAGGAGGAGGTTCCCAAACTCCTCATCTATCATAATGATCTGCTGCCCTCAGGA GTCTCTGACCGATTCTCTGGCTCCAAGTCTGGCACCTCAGCCTCCCTGGCCATCAGTG GGCTCCAGTCTGAGGATGAGGCTGATTATTACTGTGCAGTTGGGATGACAGCCTGAA TGGTGTCCTATTCGGCGGAGGGACCAAGCTGACCGTCCTAGGACAGCCCAAAGCAGCC CCATCCGTAACTCTGTTCCCACCTAGTTCAGGAGGAGCTTCAAGCAAACAAAGCCACAC TTGTTTGCCTTATTAGTGATTTTTATCCCGGTGCCGTGACAGTTGCCTGGAAAGCTGA TAGCTCACCAGTGAAAGCTGGCGTGGAGACAACCACACCATCTAAACAAGCAATAAC AAGTATGGTGCCAGCTCATATGTGAGTCTCTCACTCCAGAACAATGGAAGTCTCATCGGT CCTATAGCTGTCAAGTGACCCCAGGAGGCAGTACCGTCGAGAAGACCGTGCACCAAAC AGAGTGTAGC |
| 277 | NORI-020 | CDRH1 (IMGT) | Amino acid sequence of CDRH1 using IMGT | GDSISSHYF |
| 278 | NORI-020 | CDRH2 (IMGT) | Amino acid sequence of CDRH2 using IMGT | MYYSGST |
| 279 | NORI-020 | CDRH3 (IMGT) | Amino acid sequence of CDRH3 using IMGT | VRHNNWGLDNYFDY |
| 280 | NORI-020 | CDRH1 (KABAT) | Amino acid sequence of CDRH1 using Kabat | SSHYFWG |
| 281 | NORI-020 | CDRH2 (KABAT) | Amino acid sequence of CDRH2 using Rabat | SMYYSGSTYYNPSLRS |
| 282 | NORI-020 | CDRH3 (KABAT) | Amino acid sequence of CDRH3 using Rabat | HNNWGLDNYFDY |
| 283 | NORI-020 | Heavy chain variable region | Amino acid sequence of VH | QLQLQESGPGLVRPAETLSLMCTVSGDSISSSHYFWGWIRQPPGRGLEWIGSMYYSGS TYYNPSLRSRVTISVDTSNNQFSLRLRSVTAADTAVYYCVRHNNWGLDNYFDYWGQGT LVTVSS |
| 284 | NORI-020 | Heavy chain variable region | Nucleic acid sequence of VH | CAGCTGCAGCTGCAGGAGTCGGGCCCAGGACTGGTGAAGCCTGCGGAGACCCCTGTCCC TCATGTGCACTGTCTCTGGTGACTCCATCAGTAGTAGCCATTACTTCTGGGGCTGGAT CCGCCAGCCCCCAGGGAAGGGCCTGGAGTGGATTGGAGTATGTATTATAGTGGGAGC ACCTACTACAACCCGTCCCTCAAGAGTCGAGTCACCATATCCGTAGACACGTCCAACA ACCAGTTTCCCTGAAGCTGAGGTCTGTGACCGCCGCAGACACGGCTGTGTATTATTG TGTGAGACATAATAATTGGGGATTGGACCAACTACTTTGACTACTGGGGCCAGGGAACC CTGGTCACCGTCTCCTCA |

-continued

| SEQ ID NO | | | Description | Sequence |
|---|---|---|---|---|
| 285 | NORI-020 | Full heavy chain sequence | Amino acid sequence heavy chain | QLQLQESGPGLVRPAETLSLMCTVSGDSISSSHYFWGWIRQPPGRGLEWIGSMYYSGS TYYNPSLRSRVTISVDTSNNQFSLRLRSVTAADTAVYYCVRHNMWGLDNYFDYWGQGT LVTVSSASTRGPSVFPLAPCSRSTSESTAALGCLVRDYFPEPVTVSWNSGALTSGVHT FPAVLQSSGLYSLSSVVTVPSSSLGTKTYTCNVDHKPSNTKVDKRVESKYGPPCPPCP APEFEGGPSVFLFPPKPKDTLMISRTPEVTCVVVDVSQEDPEVQFNWYVDGVEVHNAK TKPREEQFNSTYRVVSVLTVLHQDWLNGKEYKCKVSNKGLPSSIEKTISKAKGQPREP QVYTLPPSQEEMTRNQVSLTCLVRGFYPSDIAVEWESNGQPENNYRTTPPVLDSDGSF FLYSRLTVDRSRWQEGNVFSCSVMHEALHNHYTQRSLSLSLGR |
| 286 | NORI-020 | Full heavy chain sequence | Nucleic acid sequence heavy chain | CAGCTGCAGCTGCAGGAGTCGGGCCCAGGACTGGTGAAGCCTGCGGAGACCCTGTCCC TCATGTGCACTGTCTCTGGTGACTCCATCAGTAGTAGTCATTACTTCTGGGGCTGGAT CCGCCAGCCCCCAGGGAAGGGCCTGGAGTGGGATTGGGAGTATGTATTATTATAGTGGGAGC ACCTACTACAACCCGTCCCTCAAGAGTCGAGTCACCATATCGTAGACACGTCCAACA ACCAGTTTCCTGAAGCTGAGGTCTTGTGACCGCCCAGACACGGCTGTGTATTATTG TGTGAGACATAATAATTGGGATTGGACAACTACTTTGACTACTGGGGCCAGGGAACC CTGGTCACCGTCTCCTCAGCCAGCACCAAGGGCCCTTCCGTGTTCCCCCTGGCCCTT GCAGCAGGAGCCACCTCCGAATCCACAGCTGCCCTGGGCTGTCTGGTGAAGGACTACTT CCCCGAGCCCGTGACCGTGAGCTGGAACAGCGGCGTCTACTCCTGTCCTCCGGTGACCGTGC TTAGCTCCTCCGTCCTCCAGTCCTCCGGCCTTACACCTGTAACGTGGACCACAAACCTCCAA CACCAAGGTGACAAACGGGTCGAGGACAAGCAGTACGGCCTCCCTGCCCTCTCTTGTCCT GCCCCCGAGTTCGAAGCGGACACCCGAGGTGACCTGCGTGGTGGTGGATGTGAGCCAGGA CCCTCATGATCAGCCGGAGTCAGTTCAACTGGTATGTGGATGGCGTGGAGGTGCACAACGCCAAG ACAAAGCCCCGGAAGAGCAGTCAACTTCAACTTCACCTACAGGGGTGGTCGACGGGTGCTGACCG TGCTGCATCAGGACTGGCTGAACGGCAAGGGAGTACAAGTGCAAGGTCAGCAACATAAGGG ACTGCCCAGCAGCATCGAGAGACCCATCTCCAAGGCTAAGGGCCAGCCCCGGGAACCT CAGGTGTACACCCTGCCTCCCAGCCAGGAGGAGATGACCAGGAACCAGGTGAGCCTGA CCTGCCTGGTGAAGGGATTCTACCCCTTCCGACATCGCCGTGGAGTGGGAGTCCAACGG CCAGCCCGAGAACAATTATAGAACCACCCCCTCCGTCCTGGATAAGTCCAGTGGCAGGACGGACGATCCTTC TTTCTGTACTCCAGGCTGACCGTGGATAAGTCCAGTGGCAGGCGACGGCAACGTGTTCA GCTGCTCCGTGATGCACGAGGCCCTGCACAATCACTACACCCAGAGTCCCTGAGCCT GTCCCTGGGAAAG |
| 287 | NORI-020 | CDRL1 (IMGT) | Amino acid sequence of CDRL1 using IMGT | ALPDQY |
| 288 | NORI-020 | CDRL2 (IMGT) | Amino acid sequence of CDRL2 using IMGT | KDS |
| 289 | NORI-020 | CDRL3 (IMGT) | Amino acid sequence of CDRL3 using IMGT | QSADSGSYAV |
| 290 | NORI-020 | CDRL1 (KABAT) | Amino acid sequence of CDRL1 using KABAT | SADALPDQYAY |
| 291 | NORI-020 | CDRL2 (KABAT) | Amino acid sequence of CDRL2 using KABAT | KDSERPS |

-continued

| SEQ ID NO | | Description | Sequence |
|---|---|---|---|
| 289 | NORI-020 | CDRL3 (KABAT) | Amino acid sequence of CDRL3 using KABAT | QSADSSGSYAV |
| 292 | NORI-020 | Light chain variable region | Amino acid sequence of VL | SYELTQPPSVSVSPGQTARITCSADALPDQYAVWYQQKPGQAPLLVIYKDSERPSGIP ERFSGSSSGTIVTLTIRGVQAEDEADYYCQSADSSGSYAVFGGGTKLTVL |
| 293 | NORI-020 | Light chain variable region | Nucleic acid sequence of VL | TCCTATGAGCTGACGCAGCCACCCTCGGTGTCAGTGTCCCCAGGACAGACGGCCAGGA TCACCTGCTCTGCAGATGCATTGCCAGACCAATATGCTTATTGGTACCAGCAGAAGCC AGGCCAGGCCCCTCTGTTGGTCATATAAAGACAGTGAGAGGCCCTCAGGGATCCT GAGCGGATTCTCTGGCTCCAGCTCAGGGACAATAGTCACGTTGACCATCCGTGGAGTCC AGGCAGAAGACGAGGCTGACTATTACTGTCAATCAGCAGCAGTGGTTCTTATGC GGTATTCGGCGGAGGGACCAAGTTGACCGTCCTA |
| 294 | NORI-020 | Full light chain sequence | Amino acid sequence light chain | SYELTQPPSVSVSPGQTARITCSADALPDQYAVWYQQKPGQAPLLVIYKDSERPSGIP ERFSGSSSGTIVTLTIRGVQAEDEADYYCQSADSSGSYAVFGGGTKLTVLGQPKAAPS VTLFPPSSEELQANKATLVCLISDFYPGAVTVAWKADSSPVKAGVETTTPSKQSNNKY AASSYLSLTPEQWKSHRSYSCQVTHEGSTVEKTVAPTECS |
| 295 | NORI-020 | Full light chain sequence | Nucleic acid sequence light chain | TCCTATGAGCTGACGCAGCCACCCTCGGTGTCAGTGTCCCCAGGACAGACGGCCAGGA TCACCTGCTCTGCAGATGCATTGCCAGACCAATATGCTTATTGGTACCAGCAGAAGCC AGGCCAGGCCCCTCTGTTGGTCATATAAAGACAGTGAGAGGCCCTCAGGGATCCT GAGCGGATTCTCTGGCTCCAGCTCAGGGACAATAGTCACGTTGACCATCCGTGGAGTCC AGGCAGAAGACGAGGCTGACTATTACTGTCAATCAGCAGCAGTGGTTCTTATGC GGTATTCGGCGGAGGGACCAAGTTGACCGTCCTAGGTCAGCCCAAAAGCAGCCCATCC GTAACTCTGTTCCCACCTAGTTTCAGAGGAGCTTCAGCAGTTGCCTGGAAAGCTGATAGCTC ACCAGTGAAAGCTGGCGTGGAGACACACCACCATCTAAACAAAGCAATAACAAGTAT GCTGCCAGCTCATATCTGAGTCCACTCCGAACAATGGAAGTCTCATCCGTCCTATA GCTGTCAAGTGACCCCACGAAGGCAGTACCGTCGAGAAGACCGTGGCACCACCAGAGTG TAGC |
| 296 | NORI-021 | CDRH1 (IMGT) | Amino acid sequence of CDRH1 using IMGT | GFTFSDYY |
| 297 | NORI-021 | CDRH2 (IMGT) | Amino acid sequence of CDRH2 using IMGT | ISSSGRTR |
| 298 | NORI-021 | CDRH3 (IMGT) | Amino acid sequence of CDRH3 using IMGT | ARAQLRYFDWLDY |
| 299 | NORI-021 | CDRH1 (KABAT) | Amino acid sequence of CDRH1 using Kabat | DYYMG |
| 300 | NORI-021 | CDRH2 (KABAT) | Amino acid sequence of CDRH2 using Kabat | HISSSGRTRYYADSVKG |
| 301 | NORI-021 | CDRH3 (KABAT) | Amino acid sequence of CDRH3 using Kabat | AQLRYFDWLDY |

-continued

| SEQ ID NO | | Description | Sequence |
|---|---|---|---|
| 302 | NORI-021 | Heavy chain variable region | Amino acid sequence of VH | QVQLVESGGGLVKPGGSLRLSCAAFGFTFSDYYMGWIRQAPGKGLEWVSHISSSGRTR YYADSVKGRFTISRDNAKNALYLQMDSLRAEDTAVFYCARAQLRYIFDWLDYWGQGTLV TVSS |
| 303 | NORI-021 | Heavy chain variable region | Nucleic acid sequence of VH | CAGGTGCAGCTGGTGGAGTCTGGGGGAGGCCTGGTCAAGCCTGGAGGGTCCCTGAGAC TCTCCTGTGCAGCCTTTGGATTCACCTTCAGTGACTACTACATGGGCTGGATCCGCCA GGCTCCAGGGAAGGGGCTGGAGTGGGTTTCACACATTAGTAGTAGTGGTAGGACCAGG TACTACGACAGCTCTGTGAAGGGCCGATTCACCATCTCCAGGGACAACGCCAAGAATG CACTGTATCTGCAAATGGACAGCCTGAGAGCCGAAGACACGGCCGTATTTTACTGTGC GAGAGCCCAATTACGATATTTTGACTGGCTTGACTACTGGGGCCAGGGAACCCTGGTC ACCGTCTCCTCA |
| 304 | NORI-021 | Full heavy chain sequence | Amino acid sequence heavy chain | QVQLVESGGGLVKPGGSLRLSCAAFGFTFSDYYMGWIRQAPGKGLEWVSHISSSGRTR YYADSVKGRFTISRDNAKNALYLQMDSLRAEDTAVFYCARAQLRYIFDWLDYWGQGTLV TVSSASTKGPSVFPLAPCSRSTSESTAALGCLVKDYFPEPVTVSWNSGALTSGVHTFP AVLQSSGLYSLSSVVTVPSSSLGTKTYTCNVDHKPSNTKVDKRVESKYGPPCPPCPAP EFEGGPSVFLFPPKPKDTLMISRTPEVTCVVVDVSQEDPEVQFNWYVDGVEVHNAKTK PREEQFNSTYRVVSVLTVLHQDWLNGKEYKCKVSNKGLPSSIEKTISKAKGQPREPQV YTLPPSQEEMTKNQVSLTCLVKGFYPSDIAVEWESNGQPENNYKTTPPVLDSDGSFFL YSRLTVDKSRWQEGNVFSCSVMHEALHNHYTQKSLSLSLGK |
| 305 | NORI-021 | Full heavy chain sequence | Nucleic acid sequence heavy chain | CAGGTGCAGCTGGTGGAGTCTGGGGGAGGCCTGGTCAAGCCTGGAGGGTCCCTGAGAC TCTCCTGTGCAGCCTTTGGATTCACCTTCAGTGACTACTACATGGGCTGGATCCGCCA GGCTCCAGGGAAGGGGCTGGAGTGGGTTTCACACATTAGTAGTAGTGGTAGGACCAGG TACTACGACAGCTCTGTGAAGGGCCGATTCACCATCTCCAGGGACAACGCCAAGAATG CACTGTATCTGCAAATGGACAGCCTGAGAGCCGAAGACACGGCCGTATTTTACTGTGC GAGAGCCCAATTACGATATTTTGACTGGCTTGACTACTGGGGCCAGGGAACCCTGGTC ACCGTCTCCTCAGCCTCCACCAAGGGCCCATCGGTCTTCCCCCTGGCACCCTCCTCCA GGAGCACCTCTGGGGGCACAGCGGCCCTGGGCTGCCTGGTCAAGGACTACTTCCCGA GCCCGGTGACGGTGTCGTGGAACTCAGGCGCCCTGACCAGCGGCGTGCACACCTTCCT GCCGTCCTGCAGTCCTCAGGACTCTACTCCCTCAGCAGCGTGGTGACCGTGCCCTAGCT CCTCCCTCGGCACCCAGACCTACACCTGCAACGTGGACCACAAACCCTCCAACACCAA GGTGGACAAGCGGGTCGAGAGCAAGTACGGCCCTCCGTGCCCTCCTTGTCCTGCCCCC GAGTTCGAAGGCGGACCCAGCGTGTTCCTGTTCCCTCCAAAGCCCAAGGACACCCTCA TGATCAGCCGGACACCCGAGGTGACCTGCGTGGTGGTGGATGTGAGCCAGGAGGACCC TGAGGTCCAGTTCAACTGGTATGTGGACGGCGTGGAGGTGCACAACGCCAAGACAAAG CCCCGGGAAGAGCAGTTCAACTCCACCTACAGGGTGGTCAGCGTGCTCACCGTGCTGC ATCAGGACTGGCTGAACGGCAAGGAGTACAAGTGCAAGGTCAGCAATAAGGGACTGCC CAGCAGCATCGAGAAGACCATCTCCAAGGCTAAAGGCCAGCCCCGGGAACCTCAGGTG TACACCCTGCCTCCCAGCCAGGAGGAGATGACCAAGAACCAGGTGAGCCTGACCTGCC TGGTGAAGGGATTCTACCCTTCCGACATCGCCGTGGAGTGGGAGTCCAACGGCCAGCC CGAGAACAATTATAAGACCACCCCTCCCGTGCTGGACAGCGACGGATCCTTCTTTCTG TACTCCAGGCTGACCGTGGATAAGTCCAGGTGGCAGGAGGGCAACGTGTTCAGCTGCT CCGTGATGCACGAGGCCCTGCACAATCACTACACCCAGAAGTCCCTGAGCCTGTCCCT GGGAAAG |
| 306 | NORI-021 | CDRL1 (IMGT) | Amino acid sequence of CDRL1 using IMGT | GSNIGNNY |

-continued

| SEQ ID NO | | Description | Sequence |
|---|---|---|---|
| 307 | NORI-021 | CDRL2 (IMGT) | Amino acid sequence of CDRL2 using IMGT | DNN |
| 308 | NORI-021 | CDRL3 (IMGT) | Amino acid sequence of CDRL3 using IMGT | GTWDSSLSAGV |
| 309 | NORI-021 | CDRL1 (KABAT) | Amino acid sequence of CDRL1 using KABAT | SGSGSNIGNNVVS |
| 310 | NORI-021 | CDRL2 (KABAT) | Amino acid sequence of CDRL2 using KABAT | DNNKRPS |
| 308 | NORI-021 | CDRL3 (KABAT) | Amino acid sequence of CDRL3 using KABAT | GTWDSSLSAGV |
| 311 | NORI-021 | Light chain variable region | Amino acid sequence of VL | QSVLTQPPSVSAAPGQKVTISCSGSGSNIGNNYVSWYQQVPGTAPKLLIYDNNKRPSG IPDRFSGSKSGTSATLGITGLQTGDEADYYCGTWDSSLSAGVFGGGTKLTVL |
| 312 | NORI-021 | Light chain variable region | Nucleic acid sequence of VL | CAGTCTGTGTTGACGCAGCCGCCCTCAGTGTCTGCGGCCCCAGGACAGAAGGTCACCA TCTCCTGCTCTGGAAGCGGCTCCAACATTGGGAATAATTATGTATCCTGGTACCAGCA GGTCCCAGGAACAGCCCCCAAACTCCTCATTTATGACAATAATAAGCGACCCTCAGGG ATTCCTGACCGATTCTCTGGCTCCAAGTCTGGCACGTCAGCCATCTGGGCATCACCG GACTCCAGACTGGGGACGAGGCCGATTATTACTGCGGAACATGGGATAGCAGCCTGAG TGCTGGGGTGTTCGGCGGAGGGACCAAGCTGACCGTCCTA |
| 313 | NORI-021 | Full light chain sequence | Amino acid sequence light chain | QSVLTQPPSVSAAPGQKVTISCSGSGSNIGNNYVSWYQQVPGTAPKLLIYDNNKRPSG IPDRFSGSKSGTSATLGITGLQTGDEADYYCGTWDSSLSAGVFGGGTKLTVLGQPKAA PSVTLFPPSSEELQANKATLVCLISDFYPGAVTVAWKADSSPVKAGVETTTPSKQSNN KYAASSYLSLTPEQWKSHRSYSCQVTHEGSTVEKTVAPTECS |
| 314 | NORI-021 | Full light chain sequence | Nucleic acid sequence light chain | CAGTCTGTGTTGACGCAGCCGCCCTCAGTGTCTGCGGCCCCAGGACAGAAGGTCACCA TCTCCTGCTCTGGAAGCGGCTCCAACATTGGGAATAATTATGTATCCTGGTACCAGCA GGTCCCAGGAACAGCCCCCAAACTCCTCATTTATGACAATAATAAGCGACCCTCAGGG ATTCCTGACCGATTCTCTGGCTCCAAGTCTGGCACGTCAGCCATCTGGGCATCACCG GACTCCAGACTGGGGACGAGGCCGATTATTACTGCGGAACATGGGATAGCAGCCTGAG TGCTGGGGTGTTCGGCGGAGGGACCAAGCTGACCGTCCTAGGACAGCCCAAAAGCAGCC CCATCCGTAACTCTGTTCCCACCTAGTTCAGGAGCTTCAAGCAACAAAGCCACAC TTGTTTGCCTTATTAGTGATTTTTATCCCGGTGCCGTGACAGTTGCCTGGAAAGCTGA TAGCTCACCAGTGAAAGCTGGCGTGGAGACAACCACCACATCTAAACAAGCAATAAC AAGTATGTGCCAGCTCATATGTGAGTCCACTCCAGAACAATGGAAGTCTCATCGGT CCTATAGCTGTCAAGTGACCCACGAAGGCAGTACCGTGGAGAAGACCGTGGCACCAAC AGAGTGTAGC |
| 315 | NORI-022 | CDRH1 (IMGT) | Amino acid sequence of CDRH1 using IMGT | GFTFSTYT |
| 316 | NORI-022 | CDRH2 (IMGT) | Amino acid sequence of CDRH2 using IMGT | ISIRNSII |

-continued

| SEQ ID NO | | | Description | Sequence |
|---|---|---|---|---|
| 317 | NORI-022 | CDRH3 (IMGT) | Amino acid sequence of CDRH3 using IMGT | AREEFCGTTSCYFLDY |
| 318 | NORI-022 | CDRH1 (KABAT) | Amino acid sequence of CDRH1 using Kabat | TYTMN |
| 319 | NORI-022 | CDRH2 (KABAT) | Amino acid sequence of CDRH2 using Kabat | YISIRNSIIDYADSVKG |
| 320 | NORI-022 | CDRH3 (KABAT) | Amino acid sequence of CDRH3 using Kabat | EEFCGTTSCYFLDY |
| 321 | NORI-022 | Heavy chain variable region | Amino acid sequence of VH | EVRLVESGGGLVQSGGSLRLSCAASGFTFSTYTMNWVRQAPGKGLEWVSYISIRNSII<br>DYADSVKGRFTISRDNAKNSLYLQMNSLRDEDTAVVYCAREEFCGTTSCYFLDYWGQG<br>ILVTVSS |
| 322 | NORI-022 | Heavy chain variable region | Nucleic acid sequence of VH | GAGGTGCGGCTGGTGGAGTCTGGGGGAGGCTTGGTTCAGTCTGGGGGTCCTGAGAC<br>TCTCCTGTGCAGCCTCTGGATTCACCTTCAGTACCTATACCATGAACTGGGTCCGCCA<br>GGCTCCAGGGAAGGGGCTGGAGTGGGTTTCATACATTAGTATTAGGAATAGTATCATA<br>GACTACGCAGACTCTGTGAAGGGCCGCTTCACCATCTCCAGAGACAATGCCAAGAACT<br>CACTGTATCTGCAAATGAACAGCCTGAGAGACGAGGACACGGCTGTTATTATTGTGC<br>GAGAGAGGAGTTTTGTGGTACTACCAGCTGCTATTTCCTTGACTACTGGGGCCAGGGA<br>ATCCTGGTCACCGTCTCCTCA |
| 323 | NORI-022 | Full heavy chain sequence | Amino acid sequence heavy chain | EVRLVESGGGLVQSGGSLRLSCAASGFTFSTYTMNWVRQAPGKGLEWVSYISIRNSII<br>DYADSVKGRFTISRDNAKNSLYLQMNSLRDEDTAVVYCAREEFCGTTSCYFLDYWGQG<br>ILVTVSSASTKGPSVFPLAPCSRSTSESTAALGCLVKDYFPEPVTVSWNSGALTSGVH<br>TFPAVLQSSGLYSLSSVVTVPSSSLGTKTYTCNVDHKPSNTKVDKRVESKYGPPCPPC<br>PAPEFEGGPSVFLFPPKPKDTLMISRTPEVTCVVVDVSQEDPEVQFNWYVDGVEVHNA<br>KTKPREEQFNSTYRVVSVLTVLHQDWLNGKEYKCKVSNKGLPSSIEKTISKAKGQPRE<br>PQVYTLPPSQEEMTKNQVSLTCLVKGFYPSDIAVEWESNGQPENNYKTTPPVLDSDGS<br>FFLYSRLTVDKSRWQEGNVFSCSVMHEALHNHYTQKSLSLSLGK |
| 324 | NORI-022 | Full heavy chain sequence | Nucleic acid sequence heavy chain | GAGGTGCGGCTGGTGGAGTCTGGGGGAGGCTTGGTTCAGTCTGGGGGTCCTGAGAC<br>TCTCCTGTGCAGCCTCTGGATTCACCTTCAGTACCTATACCATGAACTGGGTCCGCCA<br>GGCTCCAGGGAAGGGGCTGGAGTGGGTTTCATACATTAGTATTAGGAATAGTATCATA<br>GACTACGCAGACTCTGTGAAGGGCCGCTTCACCATCTCCAGAGACAATGCCAAGAACT<br>CACTGTATCTGCAAATGAACAGCCTGAGAGACGAGGACACGGCTGTTATTATTGTGC<br>GAGAGAGGAGTTTTGTGGTACTACCAGCTGCTATTTCCTTGACTACTGGGGCCAGGGA<br>ATCCTGGTCACCGTCTCCTCAGCCTCCACCAAGGGCCCATCGGTCTTCCCCCTGGCCC<br>CTTGCCCAGGAGCACCCTCCGAGAGCACAGCCGCCCTGGGCTGCCTGGTCAAGGACTA<br>CTTCCCCGAGCCCGTGACGGTGAGCTGGAACTCAGGCGCCCTGACCAGCGGCGTCCAC<br>ACCTTTCCGGCTGTCCTCCAGTCCTCAGGACTCTACTCCCTCAGCAGCGTGGTGACCG<br>TGCCTAGCTCCTCCCTGGGCACCAAGACCTACACCTGTAACGTGGACCACAAACCCTC<br>CAACACCAAGGTGGACAAACGGGTCGAGAGCAAGTACGGCCCTCCGTGCCCTCCTTGT<br>CCTGCCCCGAGTTGAAGGCGACCCAGCGTGTTCCTGTTCCCTCCTAAGCCCAAGG<br>ACACCCTCATGATCAGCCGGACACCCGAGGTGACCTGCGTGGTGGTGGATGTGAGCCA<br>GGAGGACCCCGAGGTCCAGTTCAACTGGTATGTGGACGGCGTGGAGGTGCACAACGCC<br>AAGAGAAAGCCCCGGGAAGAGCAGTTCAACTCCACCTACAGGGTGGTCAGCGTGCTGA<br>CCGTGCTGCATCAGGACTGGCTGAACGGCAAGGAGTACAAGTGCAAGGTCAGCAATAA |

-continued

| SEQ ID NO | | Description | Sequence |
|---|---|---|---|
| | | | GGGACTGCCCAGCAGCATCGAGAAGACCATCTCCAAGGCTAAAGGCCAGCCCGGGAA |
| | | | CCTCAGGTGTACACCCTGCCTCCCAGCCAGGAGGATGACCAAGAACCAGGTGAGCC |
| | | | TGACCTGCCTGGTGAAGGGATTCTACCCTTCCGACATCGCCGTGGAGTGGGAGTCCAA |
| | | | CGGCCAGCCCCAGAACAATTATAAGACCACCCCTCCCGTGCTGGACAGCGACGGATCC |
| | | | TTCTTTCTGTACTCCAGGCTGACCGTGGATAAGTCCAGGTGGCAGGAAGGCAACGTGT |
| | | | TCAGCTGCTCCGTGATGCACGAGGCCCTGCACAATCACTACACCCAGAAGTCCCTGAG |
| | | | CCTGTCCCTGGGAAAG |
| 325 | NORI-022 | Amino acid sequence of CDRL1 using IMGT | SSNIGAGYD |
| | | CDRL1 (IMGT) | |
| 326 | NORI-022 | Amino acid sequence of CDRL2 using IMGT | GNS |
| | | CDRL2 (IMGT) | |
| 327 | NORI-022 | Amino acid sequence of CDRL3 using IMGT | QSYDSLSGYV |
| | | CDRL3 (IMGT) | |
| 328 | NORI-022 | Amino acid sequence of CDRL1 using KABAT | TGSSSNIGAGYDVH |
| | | CDRL1 (KABAT) | |
| 329 | NORI-022 | Amino acid sequence of CDRL2 using KABAT | GNSNRPS |
| | | CDRL2 (KABAT) | |
| 327 | NORI-022 | Amino acid sequence of CDRL3 using KABAT | QSYDSLSGYV |
| | | CDRL3 (KABAT) | |
| 330 | NORI-022 | Amino acid sequence of VL | QSVLTQPPSVSGAPGQRVTISCTGSSSNIGAGYDVHWYQQLPGTAPKLLIYGNSNRPS |
| | | Light chain variable region | GVPDRFSGSKSGTSASLAITGLQAEDEADYYCQSYDSLSGYVFGTGTKVTVL |
| 331 | NORI-022 | Nucleic acid sequence of VL | CAGTCTGTGCTGACGCAGCCGCCCTCAGTGTCTGGGGCCCCAGGTCAGAGGGTCACCA |
| | | Light chain variable region | TCTCCTGCACTGGGAGCAGCTCCAACATCGGGGCAGGTTATGATGTACACTGGTACCA |
| | | | GCAACTTCCAGGAACAGCCCCCAAACTCCTCATCTATGGTAACAGCAATCGGCCCTCA |
| | | | GGGGTCCCTGACCGATTCTCTGGCTCCAAGTCTGGCACCTCAGCCTCCCTGGCCATCA |
| | | | CTGGGCTCCAGGCTGAGGATGAGGCTGATTATTACTGCCAGTCCTATGACAGCAGCCT |
| | | | GAGTGGTTATGTCTTCGGAACTGGGACCAAGGTCACCGTCCTA |
| 332 | NORI-022 | Amino acid sequence light chain | QSVLTQPPSVSGAPGQRVTISCTGSSSNIGAGYDVHWYQQLPGTAPKLLIYGNSNRPS |
| | | Full light chain sequence | GVPDRFSGSKSGTSASLAITGLQAEDEADYYCQSYDSLSGYVFGTGTKVTVLGQPKA |
| | | | APSVLFPPSSEELQANKATLVCLISDFYPGAVTVAWKADSSPVKAGVETTTPSKQSN |
| | | | NKYAASSYLSLTPEQWKSHRSYSCQVTHEGSTVEKTVAPTECS |
| 333 | NORI-022 | Nucleic acid sequence light chain | CAGTCTGTGCTGACGCAGCCGCCCTCAGTGTCTGGGGCCCCAGGTCAGAGGGTCACCA |
| | | Full light chain sequence | TCTCCTGCACTGGGAGCAGCTCCAACATCGGGGCAGGTTATGATGTACACTGGTACCA |
| | | | GCAACTTCCAGGAACAGCCCCCAAACTCCTCATCTATGGTAACAGCAATCGGCCCTCA |
| | | | GGGGTCCCTGACCGATTCTCTGGCTCCAAGTCTGGCACCTCAGCCTCCCTGGCCATCA |
| | | | CTGGGCTCCAGGCTGAGGATGAGGCTGATTATTACTGCCAGTCCTATGACAGCAGCCT |
| | | | GAGTGGTTATGTCTTCGGAACTGGGACCAAGGTCACCGTCCTAGGACAGCCAAAGCA |
| | | | GCCCCATCCGTAACTCTGTTCCCACCTAGTTCAAGCAAGCTTCAAGCAACAAAGCCA |
| | | | CACTGTTTGCCTTATTAGTGATTTTATCCCGGTGCCGTGACAGTTGCCTGGAAAGC |

-continued

| SEQ ID NO | | Description | Sequence |
|---|---|---|---|
| 296 | NORI-023 | | TGATAGCTCACCAGTGAAAGCTGGCTGGAGACAACCACCACCATCTAAACAAAGCAAT AACAAGTATGGTGCCAGCTCATATCTGAGTCTCACTCCAGAACAATGGAAGTGTCATC GGTCCTATAGCTGTCAAGTGACCCACGAAGGCAGTACCGTCGAGAAGAACCGTGGCACC AACAGAGTGTAGC |
| 334 | NORI-023 | Amino acid sequence of CDRH1 (IMGT) | GFTFSDYY |
| 335 | NORI-023 | Amino acid sequence of CDRH2 (IMGT) | ISSSGGNR |
| 335 | NORI-023 | Amino acid sequence of CDRH3 (IMGT) | ARGGLRYFDWADF |
| 336 | NORI-023 | Amino acid sequence of CDRH1 (KABAT) | DYYMS |
| 337 | NORI-023 | Amino acid sequence of CDRH2 (KABAT) | YISSSGGNRYYADSVKG |
| 338 | NORI-023 | Amino acid sequence of CDRH3 (KABAT) | GGLRYFDWADF |
| 339 | NORI-023 | Amino acid sequence of VH | QVQLVESGGGLVKPGGSLRLSCAASGFTFSDYYMSWIRQAPGKGLEWVSYISSSGGNR YYADSVKGRFTISRDNAKNSLYLQMNSLRAEDTAVYYCARGGLRYFDWADFWGQGTLV TVSS |
| 340 | NORI-023 | Nucleic acid sequence of VH | CAGGTGCAGCTGGTGGAGTCTGGGGGAGGCTTGGTCAAGCCTGGAGGGTCCCTGAGAC TCTCCTGTGCAGCCTCTGGATTCACCTTCAGTGACTACTACATGAGCTGGATCCGCCA GGCTCCAGGGAAGGGGCTGGAGTGGGTTTCATACATTAGTAGTAGTGGTGGTAACAGA TACTATGCAGACTCTGTGAAGGGCCGATTCACCATCTCCAGGGACAACGCCAAGAACT CACTGTATCTGCAAATGAACAGCCTGAGAGCCGAGGACACGGCCGTGTATTACTGTGC GAGAGGGGGATTACGATATTTGACTGGGCTGACTTCTGGGGCCAGGGAACCCTGGTC ACCGTCTCCTCA |
| 341 | NORI-023 | Amino acid sequence heavy chain | QVQLVESGGGLVKPGGSLRLSCAASGFTFSDYYMSWIRQAPGKGLEWVSYISSSGGNR YYADSVKGRFTISRDNAKNSLYLQMNSLRAEDTAVYYCARGGLRYFDWADFWGQGTLV TVSSASTKGPSVFPLAPCSRSTSESTAALGCLVKDYFPEPVTVSWNSGALTSGVHTFP AVLQSSGLYSLSSVVTVPSSSLGTKTYTCNVDHKPSNTKVDKRVESKYGPPCPPCPAP EFEGGPSVFLFPPKPKDTLMISRTPEVTCVVVDVSQEDPEVQFNWYVDGVEVHNAKTK PREEQFNSTYRVVSVLTVLHQDWLNGKEYKCKVSNKGLPSSIEKTISKAKGQPREPQV YTLPPSQEEMTKNQVSLTCLVKGFYPSDIAVEWESNGQPENNYKTTPPVLDSDGSFFL YSRLTVDKSRWQEGNVFSCSVMHEALHNHYTQKSLSLSLGK |
| 342 | NORI-023 | Nucleic acid sequence heavy chain | CAGGTGCAGCTGGTGGAGTCTGGGGGAGGCTTGGTCAAGCCTGGAGGGTCCCTGAGAC TCTCCTGTGCAGCCTCTGGATTCACCTTCAGTGACTACTACATGAGCTGGATCCGCCA GGCTCCAGGGAAGGGGCTGGAGTGGGTTTCATACATTAGTAGTAGTGGTGGTAACAGA TACTATGCAGACTCTGTGAAGGGCCGATTCACCATCTCCAGGGACAACGCCAAGAACT CACTGTATCTGCAAATGAACAGCCTGAGAGCCGAGGACACGGCCGTGTATTACTGTGC GAGAGGGGGATTACGATATTTGACTGGGCTGACTTCTGGGGCCAGGGAACCCTGGTC |

-continued

| SEQ ID NO | | | Description | Sequence |
|---|---|---|---|---|
| | | | | ACCGTCTCCTCAGCCAGCACCAAGGGCCCTTCCGTGTTCCCCTGGCCCCTTGCAGCA<br>GGAGCACCTCCGAATCCACAGTCCTGGGCTGTCTGGTGAAGGACTACTTTCCCGA<br>GCCGGTGACCGTGAGCTGGAACAGCGGCGTCTGACCAGCGGCGTCCACACCTTTCCT<br>GCCGTCCTGCAGTCCTCCGGCCTCTACTCCCTGTCCGTGGTGACCGTGCCTAGCT<br>CCTCCCTCGGCACCAAGACCTACACCTGTAACGTGACCACAAACCCTCCAACACCAA<br>GGTGGACAAACGGGTCGAGAGCAAGTACGGCCCCTCCCTGCCCTCCTTGTCCTGCCCCC<br>GAGTTGAAGGCGACCCAGCGTGTTCCTGTTCCCTCCTAAGCCCAAGGACACCCTCA<br>TGATCAGCCGGACCCCGAGTGACCTGACCTGCGTGGTGGTGGATGTGAGCCAGGAGACCC<br>TGAGGTCCAGTTCAACTGGTATGTGGATGGCGTGGAGGTGCACAACGCCAAGACAAAG<br>CCCCGGGAAGAGCAGTTCAACTCCACCTACAGGGTGGTGTCAGCGTGCTGACCGTGCTGC<br>ATCAGGACTGGCTGAACGGCAAGGAGTACAAGTGCAAGGTCTCAGCAATAAGGGACTGCC<br>CAGCAGCATCGAGAAGACCATCTCCAAGGCTAAAGGCCAGCCCCGGGAACCTCAGTG<br>TACACCCTGCCTCCCAGCCAGGAGGAGATGACCAAGAACCAGGTGAGCCTGACCTGCC<br>TGGTGAAGGGATTCTACCCTTCCGACATCGCCGTGGAGTGGGAGTCCAACGGCCAGCC<br>CGAGAACAATTATAAGACCACCCCTCCCGTCCTGCGACAGCGACGGATCCTTCTTTCTG<br>TACTCCAGGCTGACCGTGGATAAGTCCAGGTGGCAGGAAGGCAACGTGTTCAGCTGCT<br>CCGTGATGCACGAGGCCCTGCACAATCACTACACCCAGAAGTCCCTGAGCCTGTCCCT<br>GGGAAAG |
| 343 | NORI-023 | CDRL1<br>(IMGT) | Amino acid sequence of<br>CDRL1 using IMGT | SSNIGNNY |
| 307 | NORI-023 | CDRL2<br>(IMGT) | Amino acid sequence of<br>CDRL2 using IMGT | DNN |
| 344 | NORI-023 | CDRL3<br>(IMGT) | Amino acid sequence of<br>CDRL3 using IMGT | GTWDNSLSAGV |
| 345 | NORI-023 | CDRL1<br>(KABAT) | Amino acid sequence of<br>CDRL1 using KABAT | SGSSSNIGNNYVS |
| 310 | NORI-023 | CDRL2<br>(KABAT) | Amino acid sequence of<br>CDRL2 using KABAT | DNNKRPS |
| 344 | NORI-023 | CDRL3<br>(KABAT) | Amino acid sequence of<br>CDRL3 using KABAT | GTWDNSLSAGV |
| 346 | NORI-023 | Light chain<br>variable<br>region | Amino acid sequence of<br>VL | QSVLTQPPSVSAAPGQKVTISCSGSSSNIGNNYVSWYQQLPGTAPKLLIYDNNKRPSG<br>IPDRFSGSKSGTSATLGIPELQTGDEADYYCGTWDNSLSAGVFGGGTKLTVL |
| 347 | NORI-023 | Light chain<br>variable<br>region | Nucleic acid sequence of<br>VL | CAGTCTGTGTTGACGCAGCCGCCCTCCAGTGTCTGCGGCCCAGGACAGAAGGTCACCA<br>TCTCCTGCTCTGGAAGCAGCTCCAACATTGGGAATAATTATGTATCCTGGTATCAGCA<br>GCTCCCAGGAACAGCCCCCAAACTCCTCATTTATGACAATAATAAGGCACCCTCGGGG<br>ATTCCTGACCGATTCTCTGGCTCCAAGTCTGGCACGTCAGCCACCCTGGGCATCCCCG<br>AACTCCAGACTGGGGACGAGGCCGATTATTACTGCGGAACATGGGATAACAGCCTGAG<br>TGCTGGGGTGTTCGGCGGAGGGACCAAGCTGACCGTCCTA |
| 348 | NORI-023 | Full light<br>chain | Amino acid sequence<br>light chain | QSVLTQPPSVSAAPGQKVTISCSGSSSNIGNNYVSWYQQLPGTAPKLLIYDNNKRPSG<br>IPDRFSGSKSGTSATLGIPELQTGDEADYYCGTWDNSLSAGVFGGGTKLTVLGQPKAA |

-continued

| SEQ ID NO | | Description | Sequence |
|---|---|---|---|
| | | sequence | PSVTLFPPSSEELQANKATLVCLISDFYPGAVTVAWKADSSPVKAGVETTTPSKQSNN KYAASSYLSLTPEQWKSHRSYSCQVTHEGSTVEKTVAPTECS |
| 349 | NORI-023 | Full light chain sequence / Nucleic acid sequence light chain | CAGTCTGTGTTGACGCAGCCGCCCTCAGTGTCTGCGGCCCCAGGACAGAAGGTCACCA TCTCCTGCTCTGGAAGCAGCTCCAAACATTGGGAATAATTATGTATCCTGGTATCAGCA GCTCCCAGGAACAGCCCCCAAACTCCTCATTTATGACAATAATAAGCGACCCTCGGGG ATTCCTGACCGATTCTCTGGCTCCAAGTCTGGCACGTCAGCCACCCTGGGCATCCCG AACTCCAGACTGGAGGACGAGGCCGATTATTACTGGGAACATGGGATAACAGCCTGAG TGCTGGGGTGTTCGGCGGAGGGACCAAGCTGACCGTCCTAGGACAGCCCAAAGCCAC CCATCCGTAACTCTGTTCCCACCAGTTCAGGAGGAGCTTCAAGCAACAAAGCCACAC TTGTTTGCCTTATTAGTGATTTTATCCCGGTGCCGTGACAGTTGCCTGGAAAGCTGA TAGCTCACCAGTGAAAGCTGGCGTGGAGACAACCACCATCTAAACAACAAGCAATAAC AAGTATGTGCCAGCTCATATGTGAGTCTCACTCCAGAACAATGGAAGTCTCATCGGT CCTATAGCTGTCAAGTGACCCACGAGAGGCAGTACCGTGAGAAGACCGTGGCACCAAC AGAGTGTAGC |
| 350 | NORI-024 | CDRH1 (IMGT) / Amino acid sequence of CDRH1 using IMGT | GYTFTNFG |
| 351 | NORI-024 | CDRH2 (IMGT) / Amino acid sequence of CDRH2 using IMGT | ISAYSGFT |
| 352 | NORI-024 | CDRH3 (IMGT) / Amino acid sequence of CDRH3 using IMGT | AREGYSNYEDWFDP |
| 353 | NORI-024 | CDRH1 (KABAT) / Amino acid sequence of CDRH1 using Kabat | NFGIS |
| 354 | NORI-024 | CDRH2 (KABAT) / Amino acid sequence of CDRH2 using Kabat | WISAYSGFTNFAQKFQG |
| 355 | NORI-024 | CDRH3 (KABAT) / Amino acid sequence of CDRH3 using Kabat | EGYSNYEDWFDP |
| 356 | NORI-024 | Heavy chain variable region / Amino acid sequence of VH | QVQLVQSGSPELKKPGASVKVSCKASGYTFTNFGISWVRQAPGQGLEWMGWISAYSGFT NFAQKFQGRVSMTTDTSTSTVYMELKSLRSDDTAVYYCAREGYSNYEDWFDPWGQGTL VTVSS |
| 357 | NORI-024 | Heavy chain variable region / Nucleic acid sequence of VH | CAGGTTCAGCTGGTGCAGTCTGGACCTGAGTTGAAGAAGCCTGGGGCCTCAGTGAAGG TCTCCTGCAAGGCTTCTGGTTACACATTTACCAACTTTGGTATCAGCTGGGTGCGACA GGCCCCTGGACAAGGGCTTGAGTGGATGGGCTGGATCAGCGCTTACAGTGGTTTCACA AACTTTGCACAGAAGTTCCAGGGCAGAGTCATGACCATCACAGACACATCCAGCAGCA CAGTCTACATGGAGCTGAAGAGCCTGAGATCTGACGACACCGCCGTATATTACTGTGC GAGAGAGGGTTACAGTAACTACGAGGACTGGTTCGACCCCTGGGGCCAGGGAACCCTG GTCACCGTCTCCTCA |
| 358 | NORI-024 | Full heavy chain sequence / Amino acid sequence heavy chain | QVQLVQSGSPELKKPGASVKVSCKASGYTFTNFGISWVRQAPGQGLEWMGWISAYSGFT NFAQKFQGRVSMTTDTSTSTVYMELKSLRSDDTAVYYCAREGYSNYEDWFDPWGQGTL VTVSSASTKGPSVFPLAPCSRSTSESTAALGCLVKDYFPEPVTVSWNSGALTSGVHTF PAVLQSSGLIYLSSVVTVPSSSLGTKTYTCNVDHKPSNTKVDKRVESKYGPPCPPCPA |

-continued

| SEQ ID NO | | Description | Sequence |
|---|---|---|---|
| 359 | NORI-024 Full heavy chain sequence | Nucleic acid sequence heavy chain | PEFEGGPSVFLFPPKPKDTLMISRTPEVTCVVVDVSQEDPEVQFNWYVDGVEVHNAKT KPREEQFNSTYRVVSVLTVLHQDWLNGKEYKCKVSNKGLPSSIEKTISKAKGQPREPQ VYTLPPSQEEMTKNQVSLTCLVKGFYPSDIAVEWESNGQPENNYKTTPPVLDSDGSFF LYSRLTVDKSRWQEGNVFSCSVMHEALHNHYTQKSLSLSLGK |
| | | | CAGGTTCAGCTGGTGCAGTCTGGACCTGAGTTGAAGAAGCCTGGGGCCTCAGTGAAGG TCTCCTGCAAGGCTTCTGGTTACACCTTTACCAACTTTGGTATCAGCTGGGTGCGACA GGCCCCTGGACAAGGGCTTGAGTGGATGGGCTGGATCAGCCTTACAGTGGTTTCACA AACTTTGCACAGAAGTTCCAGGGCAGAGTCAGCATCTGAGACACATCCAGCAGCAGCA CAGTCTACATGGAGCTGAAGAGCCTGAGATCTGAGGACTGGTTCGACCCCTGGGCGCCAGGGAACCCTG GAGAGAGGGTTACAGTAACTACGAGGACTGGTTCGACCCCTTCCGTGTTCCCCTGGCCCTTGCA GTCACCGTCTCCTCAGCCACCAAGGGCCCTTCCGTGTTCCCCTGGCCCCTTGCA GCAGGAGCCACCTCCGAATCCACAGCCTGCCCTGGCGTGTCTGGTGAAGGACTACTTTCC CGAGCCCGTGACCGTGAGCTGGAACAGCGGCGTCTTCCAATCCGGCGTCCACACCTTT CCTGCCGTCCTGCAGTCCTCCGGCCTCTACTCCCTGTCCTCCGTGTGACCGTGCCTA GCTCCTCCCTGCGCCACCAAGACCTACACCTGTAACGTGGACCACAAACCCTCCAACAC CAAGGTGGACAAACGGGTCGAGAGCAAGTACGGCCCTCCCCTGCCCCTCCTTGTCCTGCC CCCGAGGTTCGAAGGCGGCGACCCCCAGCGTGTTCCTGTTCCCTCCAAAGCCCAAGGACACCC TCATGATCAGCCGGACCCCCGAGGTGACCTGCGTGGTGGTGGATGTGAGCCAGGAGGA CCCTGAGGTCCAGTTCAACTGGTATGTGGATGGCGTGGAGGTGCACAACGCCAAGACA AAGCCCCGGGAAGAGCAGTTCAACTCCACCTACAGGGTGGTCAGCGTGCTGACCGTGC TGCATCAGGACTGGCTGAACGGCAAGGAGTACAAGTGCAAGGTCAGCAATAAGGGACT GCCCAGCAGCATCGAGAAGACCATCTCCAAGGCTAAAGGCCAGCCCCGGGAACCTCAG GTGTACACCCTGCCTCCCAGCCAGGAGGAGATGACCAAGAACCAGGTGAGCCTGACCT GCCTGGTGAAGGGATTCTACCCTTCCGACATCGCCGTGGAGTGGGAGTCCAACGGCCA GCCCGAGAACAATTATAAGACCACCCCTCCCGTGCTGGACAGCGACGGATCCTTCTTT CTGTACTCCAGGCTGACCGTGGATAAGTCCAGGTGGCAGGAAGGCAACGTGTTCAGCT GCTCCGTGATGCACGAGGCCCTGCACAATCACTACACCCAGAAGTCCCTGAGCCTGTC CCTGGGAAAG |
| 360 | NORI-024 CDRL1 (IMGT) | Amino acid sequence of CDRL1 using IMGT | ALPKKY |
| 361 | NORI-024 CDRL2 (IMGT) | Amino acid sequence of CDRL2 using IMGT | EDS |
| 362 | NORI-024 CDRL3 (IMGT) | Amino acid sequence of CDRL3 using IMGT | YSTDSGNHRV |
| 363 | NORI-024 CDRL1 (KABAT) | Amino acid sequence of CDRL1 using KABAT | SGDALPKKYAY |
| 364 | NORI-024 CDRL2 (KABAT) | Amino acid sequence of CDRL2 using KABAT | EDSKRPS |
| 362 | NORI-024 CDRL3 (KABAT) | Amino acid sequence of CDRL3 using KABAT | YSTDSGNHRV |

-continued

| SEQ ID NO | | Description | Sequence |
|---|---|---|---|
| 365 | NORI-024 | Light chain variable region | Amino acid sequence of VL | SYELTQPPSVSVSPGQTARITCSGDALPKKYAYWYQQKSGQAPVLVIYEDSKRPSGIP ERISGSNSGTMATLTISGAQVEDEADYYCYSTDSSGNHRVFGGGTKLTVL |
| 366 | NORI-024 | Light chain variable region | Nucleic acid sequence of VL | TCCTATGAGCTGACACAGCCACCCTCGGTGTCAGTGTCCCAGGACAAACGGCCAGGA TCACCTGCTCTGGAGATGCATTGCCAAAAAAATATGCTTACTGGTACCAGCAGAAGTC AGGCCAGGCCCCTGTGCTGGTCATCTATGAGGACAGCAAACGACCCTCCGGGATCCCT GAGAGAATCTCTGGCTCCAACTCAGGGACAATGGCCACCTTGACTATCAGTGGGGCCC AGGTGGAGGATGAAGCTGACTACTACTGTTACTCAACAGACAGCAGTGGTAATCATAG GGTATTCGGCGGAGGGACCAAGCTGACCGTCCTA |
| 367 | NORI-024 | Full light chain sequence | Amino acid sequence light chain | SYELTQPPSVSVSPGQTARITCSGDALPKKYAYWYQQKSGQAPVLVIYEDSKRPSGIP ERISGSNSGTMATLTISGAQVEDEADYYCYSTDSSGNHRVFGGGTKLTVLGQPKAAPS VTLFPPSSEELQANKATLVCLISDFYPGAVTVAWKADSSPVKAGVETTTPSKQSNNKY AASSYLSLTPEQWKSHRSYSCQVTHEGSTVEKTVAPTECS |
| 368 | NORI-024 | Full light chain sequence | Nucleic acid sequence light chain | TCCTATGAGCTGACACAGCCACCCTCGGTGTCAGTGTCCCAGGACAAACGGCCAGGA TCACCTGCTCTGGAGATGCATTGCCAAAAAAATATGCTTACTGGTACCAGCAGAAGTC AGGCCAGGCCCCTGTGCTGGTCATCTATGAGGACAGCAAACGACCCTCCGGGATCCCT GAGAGAATCTCTGGCTCCAACTCAGGGACAATGGCCACCTTGACTATCAGTGGGGCCC AGGTGGAGGATGAAGCTGACTACTACTGTTACTCAACAGACAGCAGTGGTAATCATAG GGTATTCGGCGGAGGGACCAAGCTGACCGTCCTAGGTCAGCCCAAGGCTGCCCCCTCA TCAGTGTCTCGCGCCCCAGGACAGAAGGTCACCATCTCCTGCTCTGGAAGCAGCTCCA CCTCATTATGACAATAATAAGCGACCCTCGGGATTCTGACCGATTCTCTGGCTCC AAGTCTGGCACGTCAGCCACCCTGGGCATCCCCGAGCTGGGGTGTTCGGCGGAGGGAC ATTATTACTGCGGAACATGGGGATAACAGCCTGGGATAACAGCCCCAAAAGCAGCCCCATCCGTAACTCTGTTCCCACCT AGTTCAGAGGAGCTTCAAGCAAACAAGCCCACCTGTTTGCCTTATCAGTGAAAGCTGGGT ATCCCGGTGCCGTGACAGTTGCCTGGAAAGCTGATAGCTCCAGTGAAAGCTGGGT GGAGACAACCACCACCATCTAAACAAAGCAATAACAAGTCTCATGGTCCTAGCTGTCAAGTGACCCACG AGTCTTCACTCCAGAACAACAATGGAAGTCTCATGGTCCTAGCTGTGTCAAGTGACCCACG AAGGCAGTAGCTACCGTCGAGAAGACCGTGCACCAACAGAGTGTAGC |
| 369 | NORI-025 | CDRH1 (IMGT) | Amino acid sequence of CDRH1 using IMGT | GVTFTNFD |
| 370 | NORI-025 | CDRH2 (IMGT) | Amino acid sequence of CDRH2 using IMGT | IWYDESYS |
| 227 | NORI-025 | CDRH3 (IMGT) | Amino acid sequence of CDRH3 using IMGT | ARGWTGSYVFDY |
| 228 | NORI-025 | CDRH1 (KABAT) | Amino acid sequence of CDRH1 using Kabat | NFDMH |
| 371 | NORI-025 | CDRH2 (KABAT) | Amino acid sequence of CDRH2 using Kabat | VIWYDESYSYYADSVQG |

-continued

| SEQ ID NO | | Description | Sequence |
|---|---|---|---|
| 230 | NORI-025 | CDRH3 (KABAT) | Amino acid sequence of CDRH3 using Kabat | GWTGSYVFDY |
| 372 | NORI-025 | Heavy chain variable region | Amino acid sequence of VH | QVQLVESGGGWQPGRSLRLSCTASGVTFTNFDMHWVRQTPGKGLEWVAVIWYDESYS YYADSVQGRFTISRDNSKNSLYLQMNSLRADDTAVYYCARGWTGSYVFDYWGQGTLVT VSS |
| 373 | NORI-025 | Heavy chain variable region | Nucleic acid sequence of VH | CAGGTGCAGCTGGTGGAGTCTGGGGGAGGCGTGGTCCAGCCTGGGAGGTCCTGAGAC TCTCCTGTACAGCGTCTGGAGTCACCTTCACTAACTTGACATGCACTGGGTCCGCCA GACTCCAGGCAAGGGGCTGGAGTGGGTGGCGGTTATTTGGTATGATGAAAGTTATTCA TATTATGCAGACTCCGTGCAGGGCCGATTCACCATCTCCAGAGACAATTCCAAGAACT CCCTGTATCTGCAAATGAACAGCCTGAGAGCCGATGACACGGCTGTGTATTACTGTGC GAGAGGGTGGACTGGGAGCTACGTCTTTGACTACTGGGGCCAGGGAACCCTGGTCACC GTCTCCTCA |
| 374 | NORI-025 | Full heavy chain sequence | Amino acid sequence heavy chain | QVQLVESGGGWQPGRSLRLSCTASGVTFTNFDMHWVRQTPGKGLEWVAVIWYDESYS YYADSVQGRFTISRDNSKNSLYLQMNSLRADDTAVYYCARGWTGSYVFDYWGQGTLVT VSSASTKGPSVFPLAPCSRSTSESTAALGCLVKDYFPEPVTVSWNSGALTSGVHTFPA VLQSSGLYSLSSVVTVPSSSLGTKTYTCNVDHKPSNTKVDKRVESKYGPPCPPCPAPE FEGGPSVFLFPPKPKDTLMISRTPEVTCVVVDVSQEDPEVQFNWYVDGVEVHNAKTKP REEQFNSTYRVVSVLTVLHQDWLNGKEYKCKVSNKGLPSSIEKTISKAKGQPREPQVY TLPPSQEEMTKNQVSLTCLVKGFYPSDIAVEWESNGQPENNYKTTPPVLDSDGSFFLY SRLTVDKSRWQEGNVFSCSVMHEALHNHYTQKSLSLSLGK |
| 375 | NORI-025 | Full heavy chain sequence | Nucleic acid sequence heavy chain | CAGGTGCAGCTGGTGGAGTCTGGGGGAGGCGTGGTCCAGCCTGGGAGGTCCTGAGAC TCTCCTGTACAGCGTCTGGAGTCACCTTCACTAACTTGACATGCACTGGGTCCGCCA GACTCCAGGCAAGGGGCTGGAGTGGGTGGCGGTTATTTGGTATGATGAAAGTTATTCA TATTATGCAGACTCCGTGCAGGGCCGATTCACCATCTCCAGAGACAATTCCAAGAACT CCCTGTATCTGCAAATGAACAGCCTGAGAGCCGATGACACGGCTGTGTATTACTGTGC GAGAGGGTGGACTGGGAGCTACGTCTTTGACTACTGGGGCCAGGGAACCCTGGTCACC GTCTCCTCAGCCAGCACAAGGGCCTGCCCTGGGCTGTCTGGTGAAGGACTACTTCCCGAGCC CGTGACCGTGAGCTGGAACAGCGGCGTCCTGACCATCCGGCTCCACCACCTTTCCTGCC GTCCTGCAGTCCTCCGGCTCTACTCCTGTCCTGCGGTGACCGTGCCCTAGCTCCT CCCTCGGCACCAAGACCTACACCTGTAACGTGGACCCACAAACCCTCCAACACCAAGGT GGACAAACGGGTCGAGCAGCCAGCGTGTTCCTGTTCCCTCCTAAGCCCAAGGACACCCTCATGA TCAGCCGGACACCCGAGGTGACCTGCGTGGTGGTGGATGTGAGCCAGGAGGACCCTGA GGTCCAGTTCAACTGGTATGTGGATGGCGTGGAGGTGCACAACGCCAAGACAAAGCCC CGGGAAGAGCAGTTCAACTCCACCTACAGGGTGGTCAGCGTGCTGACCGTGCTGCATC AGGACTGGCTGAACGGCAAGGAGTACAAGTGCAAGGTCTCCAATAAGGGACTGCCCAG CAGCATCGAGAAGACCATCTCCAAGGCTAAAGGCCAGCCCCGGGAACCTCAGGTGTAC ACCCTGCCTCCCAGCCAGGAGGAGATGACCAAGAACCAGGTGAGCCTGACCTGCCTGG TGAAGGGATTCTACCCTTCCGACATCGCCGTGGAGTGGGAGTCCAACGGCCAGCCCGA GAACAATTATAAGACCACCCCACCCGTCCTGGACAGCGACGGCTCCTTCTTTCTGTAC TCCAGGCTGACCGTGGATAAGTCCAGGTGGCAGGAGGGCAACGTGTTCAGCTGCTCCG TGATGCACGAGGCCCTGCACAATCACTACACCCAGAAGTCCCTGAGCCTGTCCCTGGG AAAG |

-continued

| SEQ ID NO | | Description | Sequence |
|---|---|---|---|
| 235 | NORI-025 | Amino acid sequence of CDRL1 using IMGT | SSNIGNNA |
| 236 | NORI-025 | Amino acid sequence of CDRL2 using IMGT | YDD |
| 376 | NORI-025 | Amino acid sequence of CDRL3 using IMGT | AAWDDSLNAVV |
| 272 | NORI-025 | Amino acid sequence of CDRL1 using KABAT | SGSSSNIGNNAVN |
| 239 | NORI-025 | Amino acid sequence of CDRL2 using KABAT | YDDLLPS |
| 376 | NORI-025 | Amino acid sequence of CDRL3 using KABAT | AAWDDSLNAVV |
| 377 | NORI-025 | Light chain variable region | QSVLTQPPSVSEAPRQRVTISCSGSSSNIGNNAVNWYQQLPGKAPKLLISYDDLLPSG<br>VSDRFSGSKSGTSASLAISGLQSADEADYCAAWDDSLNAVVFGGGTKLTVL |
| 378 | NORI-025 | Nucleic acid sequence of VL | CAGTCTGTGCTGACTCAGCCACCCTCGGTGTCTGAAGCCCCCAGGCAGAGGGTCACCA<br>TCTCCTGTTCTGGGAGCAGCTCCAACATCGGAAATAATGCTGTAAACTGGTACCAGCA<br>GCTCCCAGGAAAGGCTCCCAAACTCCTCATCTCTTATGATGAATCTGCTGCCCTCAGGG<br>GTCTCTGACCGATTCTCTGGCTCCAAGTCTGGCACCTCAGCCTCCTGGCCATCAGTG<br>GGCTCCAGTCTGCCGATGAGGCTGATTATTACTGTGCAGCATGGGATGACAGCCTGAA<br>TGCTGTGGTATTTGGCGGAGGGACCAAGCTGACCGTCCTA |
| 379 | NORI-025 | Full light chain sequence | QSVLTQPPSVSEAPRQRVTISCSGSSSNIGNNAVNWYQQLPGKAPKLLISYDDLLPSG<br>VSDRFSGSKSGTSASLAISGLQSADEADYCAAWDDSLNAVVFGGGTKLTVLGQPKAA<br>PSVTLFPPSSEELQANKATLVCLISDFYPGAVTVAWKADSSPVKAGVETTTPSKQSNN<br>KYAASSYLSLTPEQWKSHRSYSCQVTHEGSTVEKTVAPTECS |
| 380 | NORI-025 | Nucleic acid sequence light chain | CAGTCTGTGCTGACTCAGCCACCCTCGGTGTCTGAAGCCCCCAGGCAGAGGGTCACCA<br>TCTCCTGTTCTGGGAGCAGCTCCAACATCGGAAATAATGCTGTAAACTGGTACCAGCA<br>GCTCCCAGGAAAGGCTCCCAAACTCCTCATCTCTTATGATGAATCTGCTGCCCTCAGGG<br>GTCTCTGACCGATTCTCTGGCTCCAAGTCTGGCACCTCAGCCTCCTGGCCATCAGTG<br>GGCTCCAGTCTGCCGATGAGGCTGATTATTACTGTGCAGCATGGGATGACAGCCTGAA<br>TGCTGTGGTATTTGGCGGAGGGACCAAGCTGACCGTCCTACAGTCTGTTTGACCGCAG<br>CCGCCCCAGTGTCTGCGCCCCCAGGACAGAAGGTCACCATCTCCTGCTCTGGAAGCA<br>GCTCCAACATTGGGAATAATTATGTATCCTGGTATCAGCAGCTCCCAGGAACAGCCCC<br>CAAACTCCTCATTTATGACAATAATAAGCGACCCTCGGGATTCCTGACCGATTCTCT<br>GGCTCCAAGTCTGGCACGTCAGCCACCCTGGGCATCCCCGAACTCCAGACTGGGGACG<br>AGGGACCAAGCTGACCGTCCTAGGACAGCCAAAAGCAGCCCCATCCGTAACTCTGTTC<br>CCACCTAGTTCAGAGAGGAGCTTCAAGCAAACAAAGCCACACTTGTTTGCCTTATTAGTG |

-continued

| SEQ ID NO | | Description | Sequence |
|---|---|---|---|
| 381 | NORI-026 | CDRH1 (IMGT) | ATTTTTATCCCGGTGCCTGACAGTTGCCTGGAAAGCTGATAGCTCACCAGTGAAAGC TGGCGTGGAGACAACCACCACCATCTAAACAAACAATAACAAGTATGGTGCCAGCTCA TATCTGAGTCTCACTCCAGAACAATGGAAGTCTCATCGGTCCTATAGCTGTCAAGTGA CCCACGAAGGCAGTACCGTCGAGAAGACCGTGGCCACCAACAGAGTGTAGC |
| 382 | NORI-026 | Amino acid sequence of CDRH1 using IMGT | GFTFSYFG |
| 383 | NORI-026 | Amino acid sequence of CDRH2 using IMGT | ISYDGSDE |
| 384 | NORI-026 | Amino acid sequence of CDRH3 using IMGT | AKETYQSLMYLEY |
| 385 | NORI-026 | Amino acid sequence of CDRH1 using Kabat | YFGMH |
| 386 | NORI-026 | Amino acid sequence of CDRH2 using Kabat | DISYDGSDENYADSVKG |
| 387 | NORI-026 | Amino acid sequence of CDRH3 using Kabat | ETYQSLMYLEY |
| 388 | NORI-026 | Amino acid sequence of VH | QVQLVESGGGVVQPGRSLRLSCAASGFTFSYFGMHWVRQAPGKGLEWVADISYDGSDE NYADSVKGRFTISRDNSKNTLSLQMNSLRAEDTAVYYCAKETYQSLMYLEYWGQGILV TVSS |
| 389 | NORI-026 | Nucleic acid sequence of VH | CAGGTGCAGCTGGTGGAGTCTGGGGGAGGCGTGGTCCAGCCTGGGAGGTCCCTGAGAC TCTCCTGTGCAGCCTCTGGATTCACCTTCAGTTATTTTGGCATGCACTGGGTCCGCCA GGCTCCAGGCAAGGGGCTGGAGTGGGTGGCAGATATCATATGATGGAAGTGATGAA AACTATGCAGACTCCGTGAAGGGCCGATTCACCATCTCCAGAGACAATTCCAAGAACA CGCTGTCTCTGCAAATGAACAGCCTGAGAGCTGAGGACACGGCTGTGTATTACTGTGC GAAAGAGACGTATCAGTCACTGATGTATCTTGAGTTACTGGGGCCAGGGGAATCCTGGTC ACCGTCTCCTCA |
| 390 | NORI-026 | Amino acid sequence heavy chain | QVQLVESGGGVVQPGRSLRLSCAASGFTFSYFGMHWVRQAPGKGLEWVADISYDGSDE NYADSVKGRFTISRDNSKNTLSLQMNSLRAEDTAVYYCAKETYQSLMYLEYWGQGILV TVSSASTKGPSVFPLAPCSRSTSESTAALGCLVKDYFPEPVTVSWNSGALTSGVHTFP AVLQSSGLYSLSSVVTVPSSSLGTKTYTCNVDHKPSNTKVDKRVESKYGPPCPPCPAP EFEGGPSVFLFPPKPKDTLMISRTPEVTCVVVDVSQEDPEVQFNWYVDGVEVHNAKTK PREEQFNSTYRVVSVLTVLHQDWLNGKEYKCKVSNKGLPSSIEKTISKAKGQPREPQV YTLPPSQEEMTKNQVSLTCLVKGFYPSDIAVEWESNGQPENNYKTTPPVLDSDGSFFL YSRLTVDKSRWQEGNVFSCSVMHEALHNHYTQKSLSLSLGK |
| | NORI-026 | Nucleic acid sequence heavy chain | CAGGTGCAGCTGGTGGAGTCTGGGGGAGGCGTGGTCCAGCCTGGGAGGTCCCTGAGAC TCTCCTGTGCAGCCTCTGGATTCACCTTCAGTTATTTTGGCATGCACTGGGTCCGCCA GGCTCCAGGCAAGGGGCTGGAGTGGGTGGCAGATATCATATGATGGAAGTGATGAA AACTATGCAGACTCCGTGAAGGGCCGATTCACCATCTCCAGAGACAATTCCAAGAACA CGCTGTCTCTGCAAATGAACAGCCTGAGAGCTGAGGACACGGCTGTGTATTACTGTGC GAAAGAGACGTATCAGTCACTGATGTATCTTGAGTTACTGGGGCCAGGGGAATCCTGGTC |

-continued

| SEQ ID NO | | Description | Sequence |
|---|---|---|---|
| | | | ACCGTCTCCTCAGCCAGCCAGCCACCAAGGGCCCTTCCGTGTTCCCCTGGCCCCTTGCAGCA |
| | | | GGAGCACCTCCGAATCCACAGTCCTGGGCTGTCTGGTGAAGGACTACTTTCCCGA |
| | | | GCCCGTGACCGTGAGCTGGAACAGCGGCGTCCTGACATCCGGCGTCCACACCTTTCCT |
| | | | GCCGTCCTGCAGTCCTCCGGCCTCTACTCCCTGTCCTCCGTGGTGACCGTGCCTAGCT |
| | | | CCTCCCTCGGCACCAAGACCTACACCTGTAACGTGGACCACAAACCCTCCAACACCAA |
| | | | GGTGGACAAACGGGTCGAGAGCAGCTGTTCCTGTTCCCTCCTAAGCCCAAGGACACCCTCA |
| | | | GAGTTCGAAGGCGGACCCGAGTGACCTGTGTTCCTGTGTGGTGGTGGATGTGAGCCACGAGGACCCC |
| | | | TGATCAGCCGGACACCCGAGTGACCTGCGTGGTGGTGGATGTGAGCACGAGGACCCCCAAAG |
| | | | CCCCGGGAAGAGCAGTTCAACTCCACCTACAGGGTGTGGTCAGGGTGCTGCTGACCGTGCTGC |
| | | | ATCAGGACTGGCTGAACGGCAAGGAGTACAAGTGCAAGGTCTCAGCAATAAGGGACTGCC |
| | | | CAGCAGCATCGAGAAGACCATCTCCAAGGCTAAAGGCCAGCCCCGGGAACCTCAGTG |
| | | | TACACCCTGCCTCCCCAGCCAGGAGGAGATGACCAAGAACCAGGTGACCTGCCTGCC |
| | | | TGGTGAAGGGATTCTACCCTTCCGACATCGCCGTGGAGTGGGAGTCCAACGGCCAGCC |
| | | | CGAGAACAATTATAAGACCACCCCTCCCGTCCTGGACAGCGACGGATCCTTCTTTCTG |
| | | | TACTCCAAGCTGACCGTGGATAAGTCCAGGTGGCAGGAAGGCAACGTGTTCAGCTGCT |
| | | | CCGTGATGCACGAGGCCCTGCACAATCACTACACCCAGAAGTCCCTGAGCCTGTCCCT |
| | | | GGGAAAG |
| 391 | NORI-026 | Amino acid sequence of CDRL1 using IMGT | QDIRND |
| 392 | NORI-026 | Amino acid sequence of CDRL2 using IMGT | TAP |
| 393 | NORI-026 | Amino acid sequence of CDRL3 using IMGT | LQDYNYPWT |
| 394 | NORI-026 | Amino acid sequence of CDRL1 using KABAT | RASQDIRNDLG |
| 395 | NORI-026 | Amino acid sequence of CDRL2 using KABAT | TAPSLQS |
| 393 | NORI-026 | Amino acid sequence of CDRL3 using KABAT | LQDYNYPWT |
| 396 | NORI-026 | Amino acid sequence of VL | AIQMTQSPSSLSASVGDRVTITCRASQDIRNDLGWYQQKPGKAPKLLIYTAPSLQSGV PSRFSGSGSGTDFTLTIGSLQPEDFATYYCLQDYNYPWTFGQGTKVEIK |
| 397 | NORI-026 | Nucleic acid sequence of VL | GCCATCCAGATGACCCAGTCTCCATCCTCCCTGTCTGCATCTGTTGGAGACAGAGTCA CCATCACTTGCCGGGCAAGTCAGGACATTAGAAATGATTTAGGCTGGTATCAGCAGAA ACCAGGGAAAGCCCCTAAGCTCCTGATCTATACTGCACCCAGTTTACAAAGTGGGGTC CCATCAAGGTTCAGCGGCAGTGGATCTGGGACAGATTTCACTCTCACCATCGGCAGCC TGCAGCCTGAAGATTTTGCAACTTATTACTGTCTACAAGATTACAATTACCCGTGGAC GTTCGGCCAAGGGACCAAGGTGGAAATCAAA |
| 398 | NORI-026 | Amino acid sequence Full light chain | AIQMTQSPSSLSASVGDRVTITCRASQDIRNDLGWYQQKPGKAPKLLIYTAPSLQSGV PSRFSGSGSGTDFTLTIGSLQPEDFATYYCLQDYNYPWTFGQGTKVEIKRTVAAPSVF |

-continued

| SEQ ID NO | | Description | Sequence |
|---|---|---|---|
| | | sequence | IFPPSDEQLKSGTASVVCLLNNFYPREAKVQWKVDNALQSGNSQESVTEQDSKDSTYS LSSTLTLSKADYEKHKVYACEVTHQGLSSPVTKSFNRGEC |
| 399 | NORI-026 | Full light chain sequence | Nucleic acid sequence light chain |
| | | | GCCATCCAGATGACCCAGTCTCCATCCTCCCTGTCTGCATCTGTTGGAGACAGAGTCA CCATCACTTGCCGGGCAAGTCAGGACATTAGAAATGATTTAGGCTGGTATCAGCAGAA ACCAGGGAAAGCCCCTAAGCTCCTGATCTATACTGCACCAGTTTACAAAGTGGGGTC CCATCAAGGTTCAGCGGCAGTGGATCTGGGACAGATTTCACTCTCACCATCGGCAGCC TGCAGCCTGAAGATTTTGCAACTTATTACTGTCTACAAGATTACAATTACCCGTGGAC GTTCGGCCAAGGGACCAAGGTGGAAATCAAACGTAACTGGCCGCCGTCCCCTCCGTGTTC ATCTTCCCACCTTCCGACGAGCAGTTGAAGTCCGGCACCGCTTCTGTCGTGTGCCTGC TGAACAACTTCTACCCCGCGAGGCCAAGGTCAGTGGAAGGTGGACAAGCCCCTGCA GTCCGGCAACTCCCAGGAATCCGTGACCGAGCAGGACTCCAAGGACAGCACCTACTCC CTGTCCTCCACCCTGACCCTGTCCAAGGCCGACTACGAGAAGCACAAGGTGTACGCCT GCGAAGTGACCCACCAGGGCCTGTCTAGCCCCGTGACCAAGTCTTTCAACCGGGGCGA GTGT |
| 400 | NORI-027 | CDRH1 (IMGT) | Amino acid sequence of CDRH1 using IMGT |
| | | | GYTFNNYG |
| 401 | NORI-027 | CDRH2 (IMGT) | Amino acid sequence of CDRH2 using IMGT |
| | | | ISAYSGYT |
| 402 | NORI-027 | CDRH3 (IMGT) | Amino acid sequence of CDRH3 using IMGT |
| | | | AREGYSNFEDWFDP |
| 403 | NORI-027 | CDRH1 (KABAT) | Amino acid sequence of CDRH1 using Kabat |
| | | | NYGIS |
| 404 | NORI-027 | CDRH2 (KABAT) | Amino acid sequence of CDRH2 using Kabat |
| | | | WISAYSGYTNIAQKFQG |
| 405 | NORI-027 | CDRH3 (KABAT) | Amino acid sequence of CDRH3 using Kabat |
| | | | EGYSNFEDWFDP |
| 406 | NORI-027 | Heavy chain variable region | Amino acid sequence of VH |
| | | | QVQLVQSGAELKKPGASVKVSCKASGYTFNNYGISWVRQAPGQGLEWMGWISAYSGYT NIAQKFQGRVTMTTDSTNTVYMELGSLRSDDTAVYYCAREGYSNFEDWFDPWGQGTL VTVSS |
| 407 | NORI-027 | Heavy chain variable region | Nucleic acid sequence of VH |
| | | | CAGGTTCAGTTGGTGCAGTCTGGAGCTGAGTTGAAGAAGCCTGGGGCCTCAGTGAAGG TCTCCTGCAAGGCTTCTGGTTACACCTTTAACAACTATGGTATCAGCTGGGTGCGACA GGCCCCTGGACAAGGGCTTGAGTGGATGGGATGGATCAGCGCTTACAGTGGTTACACA AACATTGCACAGAAGTTCCAGGGTAGAGTCACCATGACCACCGACACATCCACGAACA CAGTCTACATGGAACTGGGGAGCCTGAGATCTGACGACACACGCCGTGTATTACTGTGC GAGAGAGGGGTACAGTAACTTCGAAGACTGGTTCGACCCCTGGGGCCAGGGAACCCTG GTCACCGTCTCCTCA |
| 408 | NORI-027 | Full heavy chain sequence | Amino acid sequence heavy chain |
| | | | QVQLVQSGAELKKPGASVKVSCKASGYTFNNYGISWVRQAPGQGLEWMGWISAYSGYT NIAQKFQGRVTMTTDSTNTVYMELGSLRSDDTAVYYCAREGYSNFEDWFDPWGQGTL VTVSSASTKGPSVFPLAPCSRSTSESTAALGCLVKDYFPEPVTVSWNSGALTSGVHTF PAVLQSSGLIYSLSSVVTVPSSSLGTKTYTCNVDHKPSNTKVDKRVESKYGPPCPPCPA |

-continued

| SEQ ID NO | | Description | Sequence |
|---|---|---|---|
| 409 | NORI-027 | Full heavy chain sequence | PEFEGGPSVFLFPPKPKDTLMISRTPEVTCVVVDVSQEDPEVQFNWYVDGVEVHNAKT KPREEQFNSTYRVVSVLTVLHQDWLNGKEYKCKVSNKGLPSSIEKTISKAKGQPREPQ VYTLPPSQEEMTKNQVSLTCLVKGFYPSDIAVEWESNGQPENNYKTTPPVLDSDGSFF LYSRLTVDKSRWQEGNVFSCSVMHEALHNHYTQKSLSLSLGK |
| | | Nucleic acid sequence heavy chain | CAGGTTCAGTTGGTGCAGTCTGGAGCTGAGTTGAAGAAGCCTGGGGCCTCAGTGAAGG TCTCCTGCAAGGCTTCTGGTTACACCTTTACCAACTATGGTATCAGCTGGGTGCGACA GGCCCCTGGACAAGGGCTTGAGTGGATGGGATGGATCAGCGGTTACAGTGGTTACACA AACATTGCACAGAAGTTCCAGGTAGAGTCACCATCACCAGACACACTCACGACACCAA CAGTTCACATGGAACTGGGGAGGCCTGAGATCTGACGACACGGCCGTGTATTACTGTGC GAGAGAGGGGTACAGTAACTTCGAAGACTGGTTCGACCCCTGGGGCCAGGGAACCCTG GTCACCGTCTCCTCAGCCACCAAGGGCCCTTCCGTGTTCCCCCTGGCCCCTTGCA GCAGGAGCACCTCGGAATCCACCAGCTGCCCTGGCTGTCTGGTGAAGGACTACTTTCC CGAGCCCGTGACCGTGAGCTGGAACAGCGGCGTCTTGACATCCGGCGTCCACACCTTT CCTGCCGTCCTGCAGTCCTCCGGCTCTACTCCCTGTCCTCCGTGTGCAAACCTCCAACAC GCTCCTCCCTGCCACCAAGACCTACACCTGAACGTGGACCACAAAACCCTCCAACAC CAAGGTGGACAAACGGGTCGAGAGCAAGTACGGCCCTCCCTGCCCCCTTGTCCTGCC CCCGAGTTCGAAGGCGGACCCCAGCGTGTTCCTGTTCCCTCCCTAAGCCCAAGGACACCC TCATGATCAGCCGGACCACCGAGGTGACCTGCGTGGTGGTGGATGTGAGCCAGGAGGA CCCTGAGGTCCAGTTCAACTGGTATGTGGACGGTGGAGGTGCACAACGCCAAGACA AAGCCCGGGAAGAGAGCAGTTCAACTCCACCTACAGGGTGGTCAGCGTGCTGACCGTGC TGCATCAGGACTGGCTGAACGGCAAGGAGTACAAGTGCAAGGTCAGCAATAAGGGACT GCCCAGCAGCATCGAGAAGACCATCTCCAAGGCTAAAGGCCAGCCCCGGGAACCTCAG GTGTACACCCTGCCTCCAAGCCAGGAGGAGATGACCAAGAACCAGGTGAGCCTGACCT GCCTGGTGAAGGGATTCTACCCTTCCGACATCGCCGTGGAGTGGGAGTCCAACGGCCA GCCCGAGAACAATTATAAGACACCACCCCCTGTCCTGGATAGTGACGGCTCCTTCTTT CTGTACTCCAGGCTGACCGTGGATAAGTCCAGGTGGCAGGAAGGCAACGTGTTCAGCT GCTCCGTGATGCACGAGGCCCTGCACAATCACTACACCCAGAAGTCCCTGAGCCTGTC CCTGGGAAAG |
| 410 | NORI-027 | CDRL1 (IMGT) | Amino acid sequence of CDRL1 using IMGT | ELPKKY |
| 361 | NORI-027 | CDRL2 (IMGT) | Amino acid sequence of CDRL2 using IMGT | EDS |
| 362 | NORI-027 | CDRL3 (IMGT) | Amino acid sequence of CDRL3 using IMGT | YSTDSSGNHRV |
| 411 | NORI-027 | CDRL1 (KABAT) | Amino acid sequence of CDRL1 using KABAT | SGDELPKKYAY |
| 364 | NORI-027 | CDRL2 (KABAT) | Amino acid sequence of CDRL2 using KABAT | EDSKRPS |
| 362 | NORI-027 | CDRL3 (KABAT) | Amino acid sequence of CDRL3 using KABAT | YSTDSSGNHRV |

-continued

| SEQ ID NO | | Description | Sequence |
|---|---|---|---|
| 412 | NORI-027 | Light chain variable region | Amino acid sequence of VL | SYELTQPPSVSVSPGQTARITCSGDELPKKYAYWYQQKSGQAPVLVIYEDSKRPSGIP ERISGSNSGTMATLTISGAQVEDEADYYCYSTDSSGNHRVFGGGTKLTVL |
| 413 | NORI-027 | Light chain variable region | Nucleic acid sequence of VL | TCCTATGAGCTGACACAGCCTCCCTCGGTGTCAGTGTCCCAGGACAAACGGCCAGGA TCACCTGCTCTGGAGATGAATTGCCAAAAAAATATGCTTATTGGTACCAGCAGAAGTC AGGCCAGGCCCCTGTGCTGGTCATCTATGAGGACAGCAAACGACCCTCCGGATCCCT GAGAGAATCTCTGGCTCCAACTCAGGGACAATGGCCACCTTGACTATCAGTGGGCCC AGGTGGAGGATGAAGCTGACTACTACTGTTACTCAACAGACAGCAGTGGTAATCATAG GGTATTCGGCGGAGGGACCAAGCTGACCGTCCTA |
| 414 | NORI-027 | Full light chain sequence | Amino acid sequence light chain | SYELTQPPSVSVSPGQTARITCSGDELPKKYAYWYQQKSGQAPVLVIYEDSKRPSGIP ERISGSNSGTMATLTISGAQVEDEADYYCYSTDSSGNHRVFGGGTKLTVLGQPKAAPS VTLFPPSSEELQANKATLVCLISDFYPGAVTVAWKADSSPVKAGVETTTPSKQSNNKY AASSYLSLTPEQWKSHRSYSCQVTHEGSTVEKTVAPTECS |
| 415 | NORI-027 | Full light chain sequence | Nucleic acid sequence light chain | TCCTATGAGCTGACACAGCCTCCCTCGGTGTCAGTGTCCCAGGACAAACGGCCAGGA TCACCTGCTCTGGAGATGAATTGCCAAAAAAATATGCTTATTGGTACCAGCAGAAGTC AGGCCAGGCCCCTGTGCTGGTCATCTATGAGGACAGCAAACGACCCTCCGGATCCCT GAGAGAATCTCTGGCTCCAACTCAGGGACAATGGCCACCTTGACTATCAGTGGGCCC AGGTGGAGGATGAAGCTGACTACTACTGTTACTCAACAGACAGCAGTGGTAATCATAG GGTATTCGGCGGAGGGACCAAGCTGACCGTCCTAGGACAGCCCAAAGCCGCCCCATCC GTAACTCTGTTCCCACCTAGTTTCACCCGGTGCCTGGAAAGCTGATAGCTC ACCAGTGAAAGCTGGCGTGGGACAACCACCACCATCTAAACAAGCAATAACAAGTAT GCTGCCAGCTCATATCTGAGTCTCACTCCAGAACAATGGAAGTCTCATCGGTCCTATA GCTGTCAAGTGACCCACGAAGGCAGTACCCGTCGAGAAGACCGTGGCCACCAACAGAGTG TAGC |
| 416 | NORI-028 | CDRH1 (IMGT) | Amino acid sequence of CDRH1 using IMGT | GFILDDYG |
| 417 | NORI-028 | CDRH2 (IMGT) | Amino acid sequence of CDRH2 using IMGT | ISWNGDST |
| 418 | NORI-028 | CDRH3 (IMGT) | Amino acid sequence of CDRH3 using IMGT | AREYSGDFYYYYGMDV |
| 419 | NORI-028 | CDRH1 (KABAT) | Amino acid sequence of CDRH1 using Kabat | DYGMN |
| 420 | NORI-028 | CDRH2 (KABAT) | Amino acid sequence of CDRH2 using Kabat | GISWNGDSTRYADSVKG |
| 421 | NORI-028 | CDRH3 (KABAT) | Amino acid sequence of CDRH3 using Kabat | EYSGDFYYYYGMDV |
| 422 | NORI-028 | Heavy chain variable region | Amino acid sequence of VH | EVQLVESGGAVVRPGGSLRLSCAISGFILDDYGMNWVRQGPGKGLEWVAGISWNGDST RYADSVKGRFTISRDNAQNSLYLQMNSLRAEDTALYFCAREYSGDFYYYYGMDVWGQ GTTVTVSS |

-continued

| SEQ ID NO | | Description | Sequence |
|---|---|---|---|
| 423 | NORI-028 | Heavy chain variable region | Nucleic acid sequence of VH | GAGGTGCAGCTGGTGGAGTCTGGGGGAGGCTGTGGTACGGCCTGGGGGGTCCCTGAGGC<br>TCTCCTGTGCAATTTCTGGATTCATCTTGGATGACTATGGCATGGACTGGGTCCGCCA<br>AGGTCCAGGGAAGGGGCTGGAGTGGGTCGCTGGTATTAGTTGGAATGGTGATAGCACA<br>CGTTATGCAGACTCTGTGAAGGGCCGATTCACCATCTCCAGAGACAACGCCCAGAACT<br>CCCTGTATCTGCAAATGAAAGTCTGAGAGCCGAGACACCGGCCTTGTATTTCTGTGCG<br>AGAGAATATAGTGGACGACTTCTACTATTACTACACGGTATGGACGTCTGGGGCCAAG<br>GGACCACGGTCACCGTCTCCTCA |
| 424 | NORI-028 | Full heavy chain sequence | Amino acid sequence heavy chain | EVQLVESGGAVVRPGGSLRLSCAISGFILDDYGMNWVRQGPGKGLEWVAGISWNGDST<br>RYADSVKGRFTISRDNAQNSLYLQMNSLRAEDTALYFCAREYSGDFYYYYGMDVWGQ<br>GTTVTVSSASTKGPSVFPLAPCSRSTSESTAALGCLVKDYFPEPVTVSWNSGALISGV<br>HTFPAVLQSSGLYSLSSVVTVPSSSLGTKTYTCNVDHKPSNTKVDKRVESKYGPPCPP<br>CPAPEFEGGPSVFLFPPKPKDTLMISRTPEVTCVVVDVSQEDPEVQFNWYVDGVEVHN<br>AKTKPREEQFNSTYRVVSVLTVLHQDWLNGKEYKCKVSNKGLPSSIEKTISKAKGQPR<br>EPQVYTLPPSQEEMTKNQVSLTCLVKGFYPSDIAVEWESNGQPENNYKTTPPVLDSDG<br>SFFLYSRLTVDKSRWQEGNVFSCSVMHEALHNHYTQKSLSLSLGK |
| 425 | NORI-028 | Full heavy chain sequence | Nucleic acid sequence heavy chain | GAGGTGCAGCTGGTGGAGTCTGGGGGAGGCTGTGGTACGGCCTGGGGGGTCCCTGAGGC<br>TCTCCTGTGCAATTTCTGGATTCATCTTGGATGACTATGGCATGGACTGGGTCCGCCA<br>AGGTCCAGGGAAGGGGCTGGAGTGGGTCGCTGGTATTAGTTGGAATGGTGATAGCACA<br>CGTTATGCAGACTCTGTGAAGGGCCGATTCACCATCTCCAGAGACAACGCCCAGAACT<br>CCCTGTATCTGCAAATGAAAGTCTGAGAGCCGAGACACCGGCCTTGTATTTCTGTGCG<br>AGAGAATATAGTGGACGACTTCTACTATTACTACACGGTATGGACGTCTGGGGCCAAG<br>GGACCACGGTCACCGTCTCCTCAGCCTCCACCAAGGGCCCATCTGTCTTCCCCCTGGC<br>CCCTTGCTCAGGAGCACCTCTGACCGTGAGCTGCGGCCGCTCTGACATCCGGCCGTCC<br>TACTTTCCCCGAGCCCTGACCGTCAGTCCTCCGGCCTCACCCTGTAACGTGGACGTGAC<br>CGTGCCTAGCTCCTCCCCGCACCCAAGAACCTACACCTGTAACGTGGACCACAAACCC<br>TCCAACACCAAGGTGGACAAAGGGTCGGAGCGCAGACCCGTGTTCTGTTCCCTCCTCTT<br>GTCCTGCCCCCCGAGTTCGAAGGCGGACACCCGAGGTGACCTGCCTGGTGGTGGATGTGAGC<br>CAGGAGGACCCTGAGGTCCAGTTCAACTGGTATGTGGATGGCGTGGAGGTGCACAACG<br>CCAAGACAAAGCCCGGGAAGAGCAGTTCAACTCCACCTACAGGGTGGTCAGCGTGCT<br>GACCGTGCTGCATCAGGACTGGCTGAACGGCAAGGAGTACAAGTGCAAGTCAGCAAT<br>AAGGGACTGCCCCAGCAGCATCGAGAAGACCATCTCCAAGGCTAAAGGCCAGCCCCGGG<br>AACCTCAGGTGTACACCCTGCCCCCAGCCCAGGAGGAGATGACCAAGAACCAGGTGAG<br>CCTGACCTGCCTGGTCAAAGGATTCTACCCTTCCGACATCGCCGTGGAGTGGGAGTCC<br>AACGGCCAGCCCGAGAACAATTATAAGACCACCCCTCCCGTCCTGGACAGCGACGGAT<br>CCTTCTTTCTGTACTCCAGGCTGACCGTGGATAAGTCCAGGTGGCAGGAGGGCAACGT<br>GTTCAGCTGCTCCGTGATGCACGAGGCCCTGCACAATCACTACACCCAGAAGTCCCTG<br>AGCCTGTCCCTGGGAAAG |
| 164 | NORI-028 | CDRL1 (IMGT) | Amino acid sequence of CDRL1 using IMGT | SSDVGFYNF |
| 147 | NORI-028 | CDRL2 (IMGT) | Amino acid sequence of CDRL2 using IMGT | EVS |

-continued

| SEQ ID NO | | Description | | Sequence |
|---|---|---|---|---|
| 426 | NORI-028 | CDRL3 (IMGT) | Amino acid sequence of CDRL3 using IMGT | SSYAGSNNLV |
| 165 | NORI-028 | CDRL1 (KABAT) | Amino acid sequence of CDRL1 using KABAT | TGTSSDVGFYNFVS |
| 150 | NORI-028 | CDRL2 (KABAT) | Amino acid sequence of CDRL2 using KABAT | EVSKRPS |
| 426 | NORI-028 | CDRL3 (KABAT) | Amino acid sequence of CDRL3 using KABAT | SSYAGSNNLV |
| 427 | NORI-028 | Light chain variable region | Amino acid sequence of VL | QSALTQPPSASGSPGQSVTISCTGTSSDVGFYNFVSWYQHPGKAPKLMIYEVSKRPS GVPDRFSGSKSANTASLTVSGLQAEDEADYYCSSYAGSNNLVFGGGTKLTVL |
| 428 | NORI-028 | Light chain variable region | Nucleic acid sequence of VL | CAGTCTGCCCTGACTCAGCCTCCCTCCGCGTCCGGGTCTCCTGGACAGTCAGTCACCA TCTCCTGCACTGGAACCAGCAGTGACGTTGGTTTTATAACTTTGTCTCCTGGTACCA ACATCACCCAGGCAAAGCCCCCAAACTCATGATTTATGAGGTCAGTAAGCGGCCCTCA GGGGTCCCTGATCGCTTCTCTGGCTCCAAGTCTGCCAACACGGCCTCCCTGACCGTCT CTGGGCTCCAGGCTGAGGATGAGGCTGATTATTACTGCAGTTCATATGCAGGCAGCAA CAATTTGGTGTTCGGCGGAGGGACCAAGCTGACCGTCCTA |
| 429 | NORI-028 | Full light chain sequence | Amino acid sequence light chain | QSALTQPPSASGSPGQSVTISCTGTSSDVGFYNFVSWYQHPGKAPKLMIYEVSKRPS GVPDRFSGSKSANTASLTVSGLQAEDEADYYCSSYAGSNNLVFGGGTKLTVLGQPKAA PSVTLFPPSSEELQANKATLVCLISDFYPGAVTVAWKADSSPVKAGVETTTPSKQSNN KYAASSYLSLTPEQWKSHRSYSCQVTHEGSTVEKTVAPTECS |
| 430 | NORI-028 | Full light chain sequence | Nucleic acid sequence light chain | CAGTCTGCCCTGACTCAGCCTCCCTCCGCGTCCGGGTCTCCTGGACAGTCAGTCACCA TCTCCTGCACTGGAACCAGCAGTGACGTTGGTTTTATAACTTTGTCTCCTGGTACCA ACATCACCCAGGCAAAGCCCCCAAACTCATGATTTATGAGGTCAGTAAGCGGCCCTCA GGGGTCCCTGATCGCTTCTCTGGCTCCAAGTCTGCCAACACGGCCTCCCTGACCGTCT CTGGGCTCCAGGCTGAGGATGAGGCTGATTATTACTGCAGTTCATATGCAGGCAGCAA CAATTTGGTGTTCGGCGGAGGGACCAAGCTGACCGTCCTAGGACAGCCCAAAGCAGCC CCATCCGTAACTCTGTTTCCCACCAGTTCAGAGGAGCTTCAAGCAAACAAAGCCACAC TTGTTTGCCTTATTAGTGATTTTTATCCCGGTGCCGTGACAGTTGCCTGGAAAGCTGA TAGCTCACCAGTGAAAGCTGGCGTGGAGACAACCACACCATCTAAACAAAGCAATAAC AAGTATGCTGCCAGCTCATATGCTTGAGTCTCACTCCAGAACAATGGAAGTCTCATCGGT CCTATAGCTGTCAAGTGACCCACGAGAGGCAGTACCCTGCGAGAAGACCGTGGCACCAAC AGAGTGTAGC |
| 431 | NORI-029 | CDRH1 (IMGT) | Amino acid sequence of CDRH1 using IMGT | GFTFGDYV |
| 432 | NORI-029 | CDRH2 (IMGT) | Amino acid sequence of CDRH2 using IMGT | IRSKPYSETT |
| 433 | NORI-029 | CDRH3 (IMGT) | Amino acid sequence of CDRH3 using IMGT | TRALYDLLTGPWMGGDYFYALDV |

-continued

| SEQ ID NO | | Description | Sequence |
|---|---|---|---|
| 434 | NORI-029 | CDRH1 (KABAT) | Amino acid sequence of CDRH1 using Kabat | DYVMS |
| 435 | NORI-029 | CDRH2 (KABAT) | Amino acid sequence of CDRH2 using Kabat | FIRSKPYSETTEYAASVRG |
| 436 | NORI-029 | CDRH3 (KABAT) | Amino acid sequence of CDRH3 using Kabat | ALYDLLTGPWMGGDYFYALDV |
| 437 | NORI-029 | Heavy chain variable region | Amino acid sequence of VH | EVQLVESGGGLVKPGRSLRLSCTASGFTFGDYVMSWFRQAPGKGLEWVGFIRSKPYSE TTEYAASVRGRFTISRDDSKSIAYLQMNSLKTEDTAVYYCTRALYDLLTGPWMGGDYF YALDVWGQGTTVTVSS |
| 438 | NORI-029 | Heavy chain variable region | Nucleic acid sequence of VH | GAGGTTCAACTGGTGGAGTCTGGGGGAGGCTTGGTAAAGCCAGGGCGGTCCCTGAGAC TCTCCTGTACAGCTTCTGGATTCACCTTTGGTGATTATGTTATGAGCTGGTTCCGCCA GGCTCCAGGGAAGGGACTGGAGTGGGTAGGTTTCATTAGAAGCAAACCTTATAGTGAG ACAACAGAATACGCCGCCTCTGTGAGACAGGCAGATTCCACCATCTCAAGAGATGATTCCA AAAGCATCGCCTATCTGCAAATGAACAGCCTGAAAACCGAGACACAGCCGTGTATTA CTGTACTAGAGCCCCTTTACGATCTTTTGACTGGTCCATGGATGGAGGGGACTACTTC TACGGCTTTGGACGTCTGGGGCCAAGGGACCACGGTCACCGTCTCCTCA |
| 439 | NORI-029 | Full heavy chain sequence | Amino acid sequence heavy chain | EVQLVESGGGLVKPGRSLRLSCTASGFTFGDYVMSWFRQAPGKGLEWVGFIRSKPYSE TTEYAASVRGRFTISRDDSKSIAYLQMNSLKTEDTAVYYCTRALYDLLTGPWMGGDYF YALDVWGQGTTVTVSSASTKGPSVFPLAPCSRSTSESTAALGCLVKDYFPEPVTVSWN SGALTSGVHTFPAVLQSSGLYSLSSVVTVPSSSLGTKTYTCNVDHKPSNTKVDKRVES KYGPPCPPCPAPEFEGGPSVFLFPPKPKDTLMISRTPEVTCVVVDVSQEDPEVQFNWY VDGVEVHNAKTKPREEQFNSTYRVVSVLTVLHQDWLNGKEYKCKVSNKGLPSSIEKTI SKAKGQPREPQVYTLPPSQEEMTKNQVSLTCLVKGFYPSDIAVEWESNGQPENNYKTT PPVLDSDGSFFLYSRLTVDKSRWQEGNVFSCSVMHEALHNHYTQKSLSLSLGK |
| 440 | NORI-029 | Full heavy chain sequence | Nucleic acid sequence heavy chain | GAGGTTCAACTGGTGGAGTCTGGGGGAGGCTTGGTAAAGCCAGGGCGGTCCCTGAGAC TCTCCTGTACAGCTTCTGGATTCACCTTTGGTGATTATGTTATGAGCTGGTTCCGCCA GGCTCCAGGGAAGGGACTGGAGTGGGTAGGTTTCATTAGAAGCAAACCTTATAGTGAG ACAACAGAATACGCCGCCTCTGTGAGACAGGCAGATTCCACCATCTCAAGAGATGATTCCA AAAGCATCGCCTATCTGCAAATGAACAGCCTGAAAACCGAGACACAGCCGTGTATTA CTGTACTAGAGCCCCTTTACGATCTTTTGACTGGTCCATGGATGGAGGGGACTACTTC TACGGCTTTGGACGTCTGGGGCCAAGGGACCACGGTCACCGTCTCCTCAGCCAGCACCA AGGGCCCCTCCGTGTTCCCCCTGGCCCCTTGCAGCAGAGCCACCTCCGAATCCACAGC TGCCCTGGGCTGTCTGGTGAAGGACTACTTTCCCGAGCCCGTGACCGTGAGCTGGAAC AGCGGCGCCGTGACATCCGGCGTGCACACCTTTCCTGCCGTCCTGCAGTCCTCCGGCC TCTACTCCCTGTCCTCCGTGGTGACCGTGCCAAGCAGCTCCCTGGGCACCAAGACCTA CACCTGAACGTGGACCACAAACCCTCCAACACCAAGGTGGACAAGCGGGTCGAGAGC AGTACGGCCCCCTGCCCCTCCTGTCCTGCCCCCCGAGTTCGAAGGCGGACACCCAGCG TGTTCCTGTTCCCTCCTAAGCCCAAGGACACCCTGATGATCAGCCGGACACTGGTAT GACCTGCGTGGTGGTGGACGTGAGTGCAGAGGACCCCGAGGTGCAGTTCAACTGGTAT GTGGATGGCGTGGAGGTGCACAACGCCAAGACCAAGCCCCGGGAAGAGCAGTTCAACT CCACCTACAGGTGGTGTCAGCGTGCTGACCGTGCTGCATCAGGACTGGCTGAACGGCAA GGAGTACAAGTGCAAGTCAGCAATAAGGGACTGCCCAGCAGCATCGAGAAGACCATC TCCAAGGCTAAAGGCCAGCCCCGGGAACCTCAGGTGTACACCCTGCCTCCCAGCCAGG AGGAGATGACCAAGAACCAGGTGAGCCTGACCTGCCTGGTCAAGGGATTCTACCCTTC |

-continued

| SEQ ID NO | | Description | Sequence |
|---|---|---|---|
| | | | CGACATCGCCGTGGAGTGGGAGTCCAACGGCCAGCCCGAGAACAATTATAAGACCACC CCTCCCGTCCTCGACAGCGACGATCCTCTTTCTGTACTCCAGCTGACCGTGGATA AGTCCAGGTGGCAGGAAGGCAACGTGTTCAGCTGCTCCGTGATGCACGAGCCCTGCA CAATCACTACACCCAGAAGTCCCTGAGCCTGTCCCTGGGAAAG |
| 441 | NORI-029 CDRL1 (IMGT) | Amino acid sequence of CDRL1 using IMGT | SSDVGDYNY |
| 147 | NORI-029 CDRL2 (IMGT) | Amino acid sequence of CDRL2 using IMGT | EVS |
| 442 | NORI-029 CDRL3 (IMGT) | Amino acid sequence of CDRL3 using IMGT | KSYAGSNNLV |
| 443 | NORI-029 CDRL1 (KABAT) | Amino acid sequence of CDRL1 using KABAT | TGTSSDVGDYNYVS |
| 150 | NORI-029 CDRL2 (KABAT) | Amino acid sequence of CDRL2 using KABAT | EVSKRPS |
| 442 | NORI-029 CDRL3 (KABAT) | Amino acid sequence of CDRL3 using KABAT | KSYAGSNNLV |
| 444 | NORI-029 Light chain variable region | Amino acid sequence of VL | QSALTQPPSASGSPGQSVTISCTGTSSDVGDYNYVSWYQQHPGKAPKLMIYEVSKRPS GVPDRFSGSKSGNTASLTVSGLQAEDEADYCKSYAGSNNLVFGGGTKLTVL |
| 445 | NORI-029 Light chain variable region | Nucleic acid sequence of VL | CAGTCTGCCCTGACTCAGCCTCCCTCCGCCGTCCGGGTCTCCTGGACAGTCAGTCACCA TCTCCTGCACTGGAACCAGCAGCAGTGACGTTGGTGATTATAACTATGTCTCCTGGTACCA ACAGCACCCAGGCAAAGCCCCCAAACTCATGATTTATGAGGTCAGTAAGCGGCCCTCA GGGGTCCCTGATCGCTTCTCTGGCTCCAAGTCTGGCAACACGGCCTCCCTGACCGTCT CTGGGCTCCAGGCTGAGGATGAGGCTGATTATTACTGCAAGTCATATGCAGGCAGCAA CAATTTGGTGTTCGGCGGAGGGACCAAACTGACCGTCCTA |
| 446 | NORI-029 Full light chain sequence | Amino acid sequence light chain | QSALTQPPSASGSPGQSVTISCTGTSSDVGDYNYVSWYQQHPGKAPKLMIYEVSKRPS GVPDRFSGSKSGNTASLTVSGLQAEDEADYCKSYAGSNNLVFGGGTKLTVLGQPKAA PSVTLFPPSSEELQANKATLVCLISDFYPGAVTVAWKADSSPVKAGVETTTPSKQSNN KYAASSYLSLTPEQWKSHRSYSCQVTHEGSTVEKTVAPTECS |
| 447 | NORI-029 Full light chain sequence | Nucleic acid sequence light chain | CAGTCTGCCCTGACTCAGCCTCCCTCCGCCGTCCGGGTCTCCTGGACAGTCAGTCACCA TCTCCTGCACTGGAACCAGCAGCAGTGACGTTGGTGATTATAACTATGTCTCCTGGTACCA ACAGCACCCAGGCAAAGCCCCCAAACTCATGATTTATGAGGTCAGTAAGCGGCCCTCA GGGGTCCCTGATCGCTTCTCTGGCTCCAAGTCTGGCAACACGGCCTCCCTGACCGTCT CTGGGCTCCAGGCTGTGTTCGGCGGAGGGACCAGAAAGCAGCC CCATCCGTAACTCTGTTCCCACCTAGTTCAGAGGAGCTTCAAGCAACAAACAAAGCCACAC TTGTTTGCCTTATTAGTGATTTTATCCCGGTGCCGTGACAGTTGCCTGGAAAGCTGA |

-continued

| SEQ ID NO | | Description | Sequence |
|---|---|---|---|
| 225 | NORI-030 | | TAGCTCACCAGTGAAAGCTGGCTGGAGACAACCACCACCATCTAAACAAAGCAATAAC AAGTATGCTGCCAGCTCATATGTGACCTGAGTCTCCACTCCAGAACAATGGAAGTCTCATCGGT CCTATAGCTGTCAAGTGACCCACGAAGGCAGTACCGTCGAGAAGACCGTGCACCAAC AGAGTGTAGC |
| 448 | NORI-030 | CDRH1 (IMGT) — Amino acid sequence of CDRH1 using IMGT | GFTFSNFD |
| 449 | NORI-030 | CDRH2 (IMGT) — Amino acid sequence of CDRH2 using IMGT | ISYDGSKK |
| 450 | NORI-030 | CDRH3 (IMGT) — Amino acid sequence of CDRH3 using IMGT | AKEGYGGYDGFDY |
| 451 | NORI-030 | CDRH1 (KABAT) — Amino acid sequence of CDRH1 using Kabat | NFDMD |
| 452 | NORI-030 | CDRH2 (KABAT) — Amino acid sequence of CDRH2 using Kabat | LISYDGSKKYYADSVKG |
| 453 | NORI-030 | CDRH3 (KABAT) — Amino acid sequence of CDRH3 using Kabat | EGYGGYDGFDY |
| 453 | NORI-030 | Heavy chain variable region — Amino acid sequence of VH | QVQLVESGGGVVQPGRSLRLSCAASGFTFSNFDMDWVRQAPGRGLEWVALISYDGSKK YYADSVKGRFTISRDNSKNTLYLQMNSLRGEDTAVYFCAKEGYGGYDGFDYWGQGTLV TVSS |
| 454 | NORI-030 | Heavy chain variable region — Nucleic acid sequence of VH | CAGGTGCAGCTGGTGGAGTCTGGGGGAGGCGTGGTCCAGCCTGGGAGGTCCCTGAGAC TCTCCTGTGCAGCCTCTGGATTCACCTTCAGTAACTTTGACATGGACTGGGTCCGCCA GGCTCCAGGCAGGGGGCTGGAGTGGGTGGCACTTATATCATATGATGGAAGTAAAAAA TACTATGCAGACTCCGTGAAGGGCCGATTCACCATCTCCAGAGACAATTCCAAGAACA CGCTGTATCTGCAAATGAACAGTCTGAGAGGTGAGGACACGGCTGTATATTTCTGTGC GAAAGAGGGATATGGTGGCTACGATGGATTTGACTACTGGGGCCAGGGAACCCTGGTC ACCGTCTCCTCA |
| 455 | NORI-030 | Full heavy chain sequence — Amino acid sequence heavy chain | QVQLVESGGGVVQPGRSLRLSCAASGFTFSNFDMDWVRQAPGRGLEWVALISYDGSKK YYADSVKGRFTISRDNSKNTLYLQMNSLRGEDTAVYFCAKEGYGGYDGFDYWGQGTLV TVSSASTKGPSVFPLAPCSRSTSESTAALGCLVKDYFPEPVTVSWNSGALTSGVHTFP AVLQSSGLYSLSSVVTVPSSSLGTKTYTCNVDHKPSNTKVDKRVESKYGPPCPPCPAP EFEGGPSVFLFPPKPKDTLMISRTPEVTCVVVDVSQEDPEVQFNWYVDGVEVHNAKTK PREEQFNSTYRVVSVLTVLHQDWLNGKEYKCKVSNKGLPSSIEKTISKAKGQPREPQV YTLPPSQEEMTKNQVSLTCLVKGFYPSDIAVEWESNGQPENNYKTTPPVLDSDGSFFL YSRLTVDKSRWQEGNVFSCSVMHEALHNHYTQKSLSLSLGK |
| 456 | NORI-030 | Full heavy chain sequence — Nucleic acid sequence heavy chain | CAGGTGCAGCTGGTGGAGTCTGGGGGAGGCGTGGTCCAGCCTGGGAGGTCCCTGAGAC TCTCCTGTGCAGCCTCTGGATTCACCTTCAGTAACTTTGACATGGACTGGGTCCGCCA GGCTCCAGGCAGGGGGCTGGAGTGGGTGGCACTTATATCATATGATGGAAGTAAAAAA TACTATGCAGACTCCGTGAAGGGCCGATTCACCATCTCCAGAGACAATTCCAAGAACA CGCTGTATCTGCAAATGAACAGTCTGAGAGGTGAGGACACGGCTGTATATTTCTGTGC GAAAGAGGGGATATGGTGGCTACGATGGATTTGACTACTGGGGCCAGGGAACCCTGGTC |

-continued

US 12,570,740 B2

221                                                                 222

| SEQ ID NO | | Description | Sequence |
|---|---|---|---|
| | | | ACCGTCTCCTCAGCCAGCCAGCACCAAGGGCCCTTCCGTCGTTCCCCTGGCCCCTTGCAGCA |
| | | | GGAGCACCTCCGAATCCACAGTGCCCTGGGCTGTCTGGTGAAGGACTACTTTCCCGA |
| | | | GCCGTCCTGACCCTGAGCTGGAACAGCGGCGTCTGACCAGCCGGTCCACACCTTTCCT |
| | | | GCCGTCCTGCCAGTCCTCCGGCCTCTACTCCCTGTCCTCCGTGGTGACCGTGCCCTAGCT |
| | | | CCTCCCTCGGCCACCAAGACCTACACCTGTAACGTGACCACCAAACCCTCCAACACCAA |
| | | | GGTGGACAAACGGGTCGAGAGCAGCTGTTCCTGTTCCCTCCTCCTAAGCCCAAGGACACCCTCA |
| | | | GAGTTCGAAGGCGGACCCAGCTGTCCTCCTGTTCCCTGGTGTGGTGGATGTGAGCCAGGAGGACCCC |
| | | | TGATCAGCCGGACACCCGAGGTGACCTGCGTGGTGGTGGATGTGAGCGTGCACAACGCCAAGACAAAG |
| | | | CCCCGGGAAGAGCAGTTCAACTCACCTACAGGGTGGTCAGCGTGCTGACCGTGCTGC |
| | | | ATCAGGACTGGCTGAACGGCAAGGAGTACAAGTGCAAGGTCAGCAATAAGGGACTGCC |
| | | | CAGCAGCATCGAGAAGACCATCTCCAAGGCTAAAGGCCAGCCCCGGGAACCTCAGTG |
| | | | TACACCCTGCCTCCAGCCAGGAGGATGACCAAGAACCAGGTGAGCCTGACCTGCC |
| | | | TGGTGAAGGGATTCTACCCTTCCGACATCGCCGTGGAGTGGGAGTCCAACGGCCAGCC |
| | | | CGAGAACAATATAAGACCACCCCTCCCGTCCTGACGACGGCAGCGACGATCCTTCTTTCTG |
| | | | TACTCCAGGCTGACCGTGGATAAGTCCAGGTGGCAGGAAGCCAACGTGTTCAGCTGCT |
| | | | CCGTGATGCACGAGGCCCTGCACAATCACTACACCCAGAAGTCCCTGAGCCTGTCCCT |
| | | | GGGAAAG |
| 457 | NORI-030 | Amino acid sequence of CDRL1 using IMGT | TSNIGNNA |
| 458 | NORI-030 | Amino acid sequence of CDRL2 using IMGT | YDY |
| 459 | NORI-030 | Amino acid sequence of CDRL3 using IMGT | STWDDGLNGW |
| 460 | NORI-030 | Amino acid sequence of CDRL1 using KABAT | SGSTSNIGNNAVN |
| 461 | NORI-030 | Amino acid sequence of CDRL2 using KABAT | YDYWSS |
| 459 | NORI-030 | Amino acid sequence of CDRL3 using KABAT | STWDDGLNGW |
| 462 | NORI-030 | Light chain variable region | QSVLTQPPSVSEAPRQRVTISCSGSTSNIGNNAVNWYQQLPGKAPKLLISYDYVVSSG VSDRFSGSKSGTSASLAISGLQSADEADYYCSTWDDGLNGWFGGGTKLTVL |
| 463 | NORI-030 | Nucleic acid sequence of VL | CAGTCTGTGCTGACTCAGCCACCCTCGGTATCTGAGCCCCCAGGCAGAGGGTCACCA TCTCCTGTTCTGGAAGCACCTCCAACATCGGCAATAATGCTAAACTGGTACCAGCA GCTCCCAGGAAAGGCTCCCAAACTCCTCATCTTTATGATTATGGTGTCCTCAGGG GTCTCTGACCGCTTCTCTGGCTCCAAGTCTGGCACCTCAGTG GGCTCCAGTCTGCTGCGGATGAGGCTGAATTATTACTGTTCAACATGGGATGACGGCCTGAA TGGTGTGGTATTCGGCGGAGGGACCAAGCTGACCGTCCTA |

-continued

| SEQ ID NO | | Description | Sequence |
|---|---|---|---|
| 464 | NORI-030 | Full light chain sequence | Amino acid sequence light chain | QSVLTQPPSVSEAPRQRVTISCSGSTSNIGNNAVNWYQQLPGKAPKLLISYDYVVSSG VSDRFSGSKSGTSASLAISGLQSADEADYYCSTWDDGLNGVVFGGGTKLTVLGQPKAA PSVTLFPPSSEELQANKATLVCLISDFYPGAVTVAWKADSSPVKAGVETTTPSKQSNN KYAASSYLSLTPEQWKSHRSYSCQVTHEGSTVEKTVAPTECS |
| 465 | NORI-030 | Full light chain sequence | Nucleic acid sequence light chain | CAGTCTGTGCTGACTCAGCCACCCTCGGTATCTGGAGCCCCCAGGCAGAGGGTCACCA TCTCCTGTTCTGGAAGCACTTCCAACATCGGCAATAATGCTGTAAACTGGTACCAGCA GCTCCCAGGAAAGGCTCCCAAACTCCTCATCTCTTATGATTATGTGGTCTCCAGGG GTCTCTGACCGCTTCTCAGGCTCCAAGTCTGGCACCTCAGCTCCCTGGCCATCAGTG GGCTCCAGTCTGCGATGAGGCTGATTATTACTGTTCAACATGGATGACGGCCTGAA TGGTGTGGTATTCGGCGGAGGGACCAAGCTGACCGTCCTAGGACAGCCCAAAGCAGCC CCATCCGTAACTCTGTTCCCACCTAGTTCAGAGGAGCTTCAAGCAAACAAAGCCACAC TTGTTTGCCTTATTAGTGATTTTTATCCCGGTGCCGTGACAGTGGCCTGGAAAGCTGA TAGCTCACCAGTGAAAGCTGGCGTGGAGACAACCACACCTAAAACAAAGCAATAAC AAGTATGTGCGCAGTCATATGTGAGTCTCACTCCAGAACAATGGAAGTCTCATCGGT CCTATAGCTGTCAAGTGACCCACGAGGCAGTACCGTCGAGAAGACCGTGCACCAAC AGAGTGTAGC |
| 466 | NORI-031 | | Amino acid sequence of CDRH1 using IMGT | GGAISSSNYF |
| 467 | NORI-031 | | Amino acid sequence of CDRH2 using IMGT | MYYTGIT |
| 468 | NORI-031 | | Amino acid sequence of CDRH3 using IMGT | ARQDGFRTGWFDP |
| 469 | NORI-031 | | Amino acid sequence of CDRH1 using Kabat | SSNYFWG |
| 470 | NORI-031 | | Amino acid sequence of CDRH2 using Kabat | SMYYTGITYYNPSLKS |
| 471 | NORI-031 | | Amino acid sequence of CDRH3 using Kabat | QDGFRTGWFDP |
| 472 | NORI-031 | Heavy chain variable region | Amino acid sequence of VH | QLQLQESGPGLVKPSETLSLTCTVSGGAISSSNYFWGWIRQSPGKGLEWIGSMYYTGI TYYNPSLKSRVTISVDTSKNQLSLKVNSVTAADTAVYYCARQDGFRTGWFDPWGQGTL VTVSS |
| 473 | NORI-031 | Heavy chain variable region | Nucleic acid sequence of VH | CAGCTGCAGCTTCAGGAGTCGGGCCCAGGACTGGTGAAGCCTTCGGAGACCCTGTCCC TCACCTGCACTGTCTCTGGTGGCGCCATCAGCAGTAGTAATTACTTTTGGGGCTGGAT CCGCCAGTCCCCAGGGAAGGGCTGGAGTGGATTGGAGTATGTATTATACTGGGATC ACCTACTACAACCCGTCCCTCAAGAGTCGAGTCACCATATCCGTAGACACGTCCAAGA ACCAACTCTCCCTGAAGGTGAATTCTGTGACCGCCGCAGACACGGCTGTTTACTACTG TGCGAGACAAGATGGATTCAGAACGGGCTGGTTCGACCCCTGGGGCCAGGGAACCCTG GTCACCGTCTCCTCA |

-continued

| SEQ ID NO | | Description | Sequence |
|---|---|---|---|
| 474 | NORI-031 | Full heavy chain sequence | Amino acid sequence heavy chain | QLQLQESGPGLVKPSETLSLTCTVSGGAISSSNYFWGWIRQSPGKGLEWIGSMYYTGI TYYNPSLKSRVTISVDTSKNQLSLKVNSVTAADTAVYYCARQDGFRTGWFDPWGQGTL VTVSSASTKGPSVFPLAPCSRSTSESTAALGCLVKDYFPEPVTVSWNSGALTSGVHTF PAVLQSSGLYSLSSVVTVPSSSLGTKTYTCNVDHKPSNTKVDKRVESKYGPPCPPCPA PEFEGGPSVFLFPPKPKDTLMISRTPEVTCVVVDVSQEDPEVQFNWYVDGVEVHNAKT KPREEQFNSTYRVVSVLTVLHQDWLNGKEYKCKVSNKGLPSSIEKTISKAKGQPREPQ VYTLPPSQEEMTKNQVSLTCLVKGFYPSDIAVEWESNGQPENNYKTTPPVLDSDGSFF LYSRLTVDKSRWQEGNVFSCSVMHEALHNHYTQKSLSLSLGK |
| 475 | NORI-031 | Full heavy chain sequence | Nucleic acid sequence heavy chain | CAGCTGCAGCTTCAGGAGTCGGGCCCAGGACTGGTGAAGCCTTCGGAGACCCTGTCCC TCACCTGCACTGTCTCTGGTGGCGCCATCAGCAGTAGTAATTACTTTTGGGGCTGGAT CCGGCAGTCCCCAGGGAAGGGCTGGAGTGGATTGGGAGTATGATTATTATACTGGGATC ACCTACTACAACCCGTCCCTCAAGAGTCGAGTCACCATATCCGTAGACACGTCCAAGA ACCAACTCTCCCTGAAGGTGAATTCTGTGACCGCCCAGACACGGCTGTTTACTACTG TGCGAGACAAGATGGATTCAGAACGGGGTGGTTCGACCCCTGGGGCCCAGGGAACCCTG GTCACCGTCTCCTCAGCCAGCACCAAGGGCCTTCCGTGTTCCCCTGGCCCTGTGCA GCAGGAGCCACCTCCGAATCCACAGCTGCCCTGGGCTGTGCTGTGGTGAAGGACTACTTTCC CGAGCCCGTGACCGTGAGCTGGAACAGCGGCGTGCTCGACATCCGGCGTCCACCTTT CCTGCCGTCCTGCAGTCCTGCGTCTACTCCCGTGTCCTGGTGTGACCGTGCCTA GCTCCTCCCTGCGCCACCAAGACCTACCACCTGTAACGTGGACCACAAAACCCTCCAACAC CAAGGTGGACAAACGGGTCGAGAGCAAGTACGGCCCCTCCCGTGCCCCTTGTCCTGCC CCCGAGTTCGAAGGCGGACCACCCGAGGTGACCTGCTGCTGGTGGTGGATGGAGCCAGGAGGA TCATGATCAGCCGGACAGTTCAACTGGTATGTGGATGGCGTGGAGGTGCACAACGCCAAGACA AAGCCCCGGAAGAGAGCAGTTCAACTCCACCTACAGGGTGGTGTCAGCGTGCTGACCGTGC TGCATCAGGACTGGCTGAACGGCAAGGAGTACAAGTGCAAGGTCAGCAATAAGGGACT GTGTACACCCTGCCTCCCAGCCAGGAGGAGATGACCAAGAACCAGGTGAGCCTGACCT GCCTGGTGAAGGGATTCTACCCTTCCGACATCGCCGTGGAGTGGGAGTCCAACGGCCA GCCCGAGAACAATTATAAGACCACACCCCCGTCCTGGACAGTGGACAGCGACGGATCTTCTTT CTGTACTCCAGGCTGACCGTGGATAAGTCCAGGTGGCAGGAGGGCAACGTGTTCAGCT GCTCCGTGATGCACGAGGCCCTGCACAATCACACCCAGAAGTCCCTGAGCCTGTC CCTGGGAAAG |
| 476 | NORI-031 | CDRL1 (IMGT) | Amino acid sequence of CDRL1 using IMGT | KLGDNY |
| 477 | NORI-031 | CDRL2 (IMGT) | Amino acid sequence of CDRL2 using IMGT | QDT |
| 478 | NORI-031 | CDRL3 (IMGT) | Amino acid sequence of CDRL3 using IMGT | QAWDSRTW |
| 479 | NORI-031 | CDRL1 (KABAT) | Amino acid sequence of CDRL1 using KABAT | SGDKLGDNYVC |
| 480 | NORI-031 | CDRL2 (KABAT) | Amino acid sequence of CDRL2 using KABAT | QDTKRPS |

-continued

| SEQ ID NO | | Description | Sequence |
|---|---|---|---|
| 478 | NORI-031 | CDRL3 (KABAT) | Amino acid sequence of CDRL3 using KABAT | QAWDSRTW |
| 481 | NORI-031 | Light chain variable region | Amino acid sequence of VL | SYELTQPPSVSVSPGQTATLTCSGDKLGDNYVCWFQQKPGQSPLLVMYQDTKRPSGIP ERFSGSNSGNTATLTISGTQALDEADYYCQAWDSRTWFGGGTKLTVL |
| 482 | NORI-031 | Light chain variable region | Nucleic acid sequence of VL | TCCTATGAACTGACTCAGCCACCCTCCGTGTCCGTGTCCCCAGGACAGACAGCCACCC TCACCTGCTCTGGAGATAAATTGGGGGATAACTATGTTTGCTGGTTTCAGCAAAAGCC AGGCCAGTCCCCTCCTTGTTGGTCATGTATCAAGATACCAAGCCCTCAGGGATCCCT GAGCGATTCTCGGGCTCCAACTCTGGAAACACAGCCACTCTGACCATCAGCGGGACCC AGGCTTTGGATGAGGCTGACTATTACTGTCAGGCGTGGGACAGCCCACTGTGGTTTT CGGCGGAGGGACCAAGCTGACCGTCCTA |
| 483 | NORI-031 | Full light chain sequence | Amino acid sequence light chain | SYELTQPPSVSVSPGQTATLTCSGDKLGDNYVCWFQQKPGQSPLLVMYQDTKRPSGIP ERFSGSNSGNTATLTISGTQALDEADYYCQAWDSRTVVFGGGTKLTVLGQPKAAPSVT LFPPSSEELQANKATLVCLISDFYPGAVTVAWKADSSPVKAGVETTTPSKQSNNKYAA SSYLSLTPEQWKSHRSYSCQVTHEGSTVEKTVAPTECS |
| 484 | NORI-031 | Full light chain sequence | Nucleic acid sequence light chain | TCCTATGAACTGACTCAGCCACCCTCCGTGTCCGTGTCCCCAGGACAGACAGCCACCC TCACCTGCTCTGGAGATAAATTGGGGGATAACTATGTTTGCTGGTTTCAGCAAAAGCC AGGCCAGTCCCCTCCTTGTTGGTCATGTATCAAGATACCAAGCCCTCAGGGATCCCT GAGCGATTCTCGGGCTCCAACTCTGGGACGTGGGACAGCCGACTGTGGTTTT CGGCGGAGGGACCAAGCTGACCGTCCTAGGACAGCAAAGCAGCCCCATCCGTAACT CTGTTCCCACCTAGTTCAGAGAGGCTTCAAGCAACAAAGCCACACTGTTTGCCTTA TTAGTGATTTTTATCCCGGTGCCGTGACAGTTGCCTGGAAAGCTAATAACAAGTATGGTGCC AGCTCATATCTGAGTCTACTCCAGAACAATGGAAGTCTCATCGGTCCTATAGCTGTC AAGTGACCCACGAAGGCAGTACCGTCGAGAGACCGTGGCACCAACAGAGTGAGC |
| 485 | NORI-032 | CDRH1 (IMGT) | Amino acid sequence of CDRH1 using IMGT | GYTFSSFG |
| 486 | NORI-032 | CDRH2 (IMGT) | Amino acid sequence of CDRH2 using IMGT | ISAYNGIS |
| 487 | NORI-032 | CDRH3 (IMGT) | Amino acid sequence of CDRH3 using IMGT | ARDRANRDALDV |
| 488 | NORI-032 | CDRH1 (KABAT) | Amino acid sequence of CDRH1 using Kabat | SFGIT |
| 489 | NORI-032 | CDRH2 (KABAT) | Amino acid sequence of CDRH2 using Kabat | WISAYNGISNSAQKVQG |
| 490 | NORI-032 | CDRH3 (KABAT) | Amino acid sequence of CDRH3 using Kabat | DRANRDALDV |

-continued

| SEQ ID NO | | Description | Sequence |
|---|---|---|---|
| 491 | NORI-032 | Heavy chain variable region | Amino acid sequence of VH | QVQLVQSGAEVRKPGAAVKVSCKASGYTFSSFGITWIRQAPGQGLEWMGWISAYNGIS NSAQKVQGRVTMTTDTSTSTAYMELRSLRSDDSAVYYCARDRANRDALDVWGQGTKVT VSL |
| 492 | NORI-032 | Heavy chain variable region | Nucleic acid sequence of VH | CAGGTTCAACTGGTGCAATCTGGAGCTGAGGTGAGGAAGCCTGGGGCCGCAGTGAAGG TCTCCTGCAAGGCTTCTGGTTACACCTTTCCAGCTTTGGTATCACCTGGATACGACA GGCCCCTGGACAAGGGCTTGAGTGGATGGGATGGATCAGCGCTTACAATGTATCTCA AACTCTGCACAGAAGTCCAGGGAGGCCTGAGATCTGACAGCCACCAGACACATCCACGACA CAGCCTACATGGAACTGAGGAGCCTGAGATCTGACAGCTCGGCCGTATATTACTGTGC GAGAGATCGGGCGAATAGGGATGTCTTGATGTCTGGGGACCAAGGGACAAAGGTCACC GTCTCTTTA |
| 493 | NORI-032 | Full heavy chain sequence | Amino acid sequence heavy chain | QVQLVQSGAEVRKPGAAVKVSCKASGYTFSSFGITWIRQAPGQGLEWMGWISAYNGIS NSAQKVQGRVTMTTDTSTSTAYMELRSLRSDDSAVYYCARDRANRDALDVWGQGTKVT VSLASTKGPSVFPLAPCSRSTSESTAALGCLVKDYFPEPVTVSWNSGALTSGVHTFPA VLQSSGLYSLSSVVTVPSSSLGTKTYTCNVDHKPSNTKVDKRVESKYGPPCPPCPAPE FEGGPSVFLFPPKPKDTLMISRTPEVTCVVVDVSQEDPEVQFNWYVDGVEVHNAKTKP REEQFNSTYRVVSVLTVLHQDWLNGKEYKCKVSNKGLPSSIEKTISKAKGQPREPQVY TLPPSQEEMTKNQVSLTCLVKGFYPSDIAVEWESNGQPENNYKTTPPVLDSDGSFFLY SRLTVDKSRWQEGNVFSCSVMHEALHNHYTQKSLSLSLGK |
| 494 | NORI-032 | Full heavy chain sequence | Nucleic acid sequence heavy chain | CAGGTTCAACTGGTGCAATCTGGAGCTGAGGTGAGGAAGCCTGGGGCCGCAGTGAAGG TCTCCTGCAAGGCTTCTGGTTACACCTTTCCAGCTTTGGTATCACCTGGATACGACA GGCCCCTGGACAAGGGCTTGAGTGGATGGGATGGATCAGCGCTTACAATGTATCTCA AACTCTGCACAGAAGTCCAGGGAGGCCTGAGATCTGACAGCCACCAGACACATCCACGACA CAGCCTACATGGAACTGAGGAGTCCTGAGATCTGACAGCTCGGCCGTATATTACTGTGC GAGAGATCGGGCGAATAGGGATGTCTTGATGTCTGGGGACCAAGGGACAAAGGTCACC GCACCTCGAATCCACAGGCTGCCCCGGTGCTGTCTGGTGAAGGACTACTTTCCCGAGCC CGTGACCGTGAGCTGGAACAGCGGCGTCCTCGACATCCGGCGTCCACACCTTTCCTGCC GTCCTGCAGTCCTCCGGCCTCTACTTCCCTGGTGTGTGACCGTGACCGTGCCTAGCTCCT CCCTCGGCACCCAAGACCTACACCTGTAACGTGAATGGACCACAAACCTCCAACACCAAGGT GGACAAACGGGTCAGAGCAAGTACGGCCCCTCCTGTCCCCCTTGTCCTGCCCCGGAG TTCGAAGGCGGACCCCAGCGTGTTCCTGTTCCCTCCAAAGCCCCAAGGACACCCTCATGA TCAGCCGGACACCCGAGGTGACCTGCGTGGTGGTGGATGTGAGCCAGGAGGACCCTGA GGTCCAGTTCAACTGGTATGTGGATGGCGTGGAGGTGCACAACGCCAAGACAAAGCCC CGGGAAGAGCAGTTCAACTCCACCTACAGGGTGGTCAGCGTGCTCAGCGTGCTGCATC AGGACTGGCTGAACGGCAAGGAGTACAAGTGCAAGGTCAGCAATAAGGGACTGCCCAG CAGCATCGAGAAGACCATCTCCAAGGCTAAAGGCCAGCCCCGGGAACCTCAGGTGTAC ACCCTGCCTCCCAGCCAGGAGGAGATGACCAAGAACCAGGTGAGCCTGACCTGCCTGG TGAAGGGATTCTACCCTTCCGACATCGCCGTGGAGTGGGAGTCCAACGGCCAGCCCGA GAACAATTATAAGACCACCCCTCCCGTGCTGGACTCCGACGGCAGCTTCTTTCTGTAC TCCAGGCTGACCGTGGATAAGTCCAGTGGCCAGGAAGGCAACGTGTTCAGCTGCTCCG TGATGCACGAGGCCCTGCACAATCACTACACCCAGAAGTCCCTGAGCCTGTCCCTGGG AAAG |
| 495 | NORI-032 | CDRL1 (IMGT) | Amino acid sequence of CDRL1 using IMGT | ELGDRY |

-continued

| SEQ ID NO | | Description | Sequence |
|---|---|---|---|
| 477 | NORI-032 | CDRL2 (IMGT) | Amino acid sequence of CDRL2 using IMGT | QDT |
| 256 | NORI-032 | CDRL3 (IMGT) | Amino acid sequence of CDRL3 using IMGT | QAWDSSTW |
| 496 | NORI-032 | CDRL1 (KABAT) | Amino acid sequence of CDRL1 using KABAT | SGDELGDRYAC |
| 480 | NORI-032 | CDRL2 (KABAT) | Amino acid sequence of CDRL2 using KABAT | QDTKRPS |
| 256 | NORI-032 | CDRL3 (KABAT) | Amino acid sequence of CDRL3 using KABAT | QAWDSSTW |
| 497 | NORI-032 | Light chain variable region | Amino acid sequence of VL | SHELTQPPSMSVSPGQTASITCSGDELGDRYACWYQQKPGQSPVLVIYQDTKRPSGIP ERFSGSISGNTATLTISGTQAMDEADYYCQAWDSSTVVFGGGTKLTVL |
| 498 | NORI-032 | Light chain variable region | Nucleic acid sequence of VL | TCCCATGAACTGACTCAGCCACCCTCAATGTCCGTGTCCCCAGGACAGACTGCCAGCA TCACCTGCTCTGGAGATGAATTGGGGGATAGATATGCTTGCTGGTATCAACAGAAGCC AGGCCAGTCCCCTGTCCTGTTACTGGTCATCTATCAAGATACCAAGCGGCCCTCAGGGATCCCT GAGCGATTCTCTGGCTCCATCTCTGGGAACACAGCCACTCTGACCATCAGCGGGACCC AGGCTATGGATGAGGCTGACTATTACTGTCAGGCGTGGGACAGCAGCACTGTGGTATT CGGCCGAGGGGACCAAGTTGACCGTCCTA |
| 499 | NORI-032 | Full light chain sequence | Amino acid sequence light chain | SHELTQPPSMSVSPGQTASITCSGDELGDRYACWYQQKPGQSPVLVIYQDTKRPSGIP ERFSGSISGNTATLTISGTQAMDEADYYCQAWDSSTVVFGGGTKLTVLGQPKAAPSVT LFPPSSEELQANKATLVCLISDFYPGAVTVAWKADSSPVKAGVETTTPSKQSNNKYAA SSYLSLTPEQWKSHRSYSCQVTHEGSTVEKTVAPTECS |
| 500 | NORI-032 | Full light chain sequence | Nucleic acid sequence light chain | TCCCATGAACTGACTCAGCCACCCTCAATGTCCGTGTCCCCAGGACAGACTGCCAGCA TCACCTGCTCTGGAGATGAATTGGGGGATAGATATGCTTGCTGGTATCAACAGAAGCC AGGCCAGTCCCCTGTCCTGTTACTGGTCATCTATCAAGATACCAAGCGGCCCTCAGGGATCCCT GAGCGATTCTCTGGCTCCATCTCTGGGAACACAGCCACTCTGACCATCAGCGGGACCC AGGCTATGGATGAGGCTGACTATTACTGTCAGGCGTGGGACAGCAGCACTGTGGTATT CGGCCGAGGGGACCAAGTTGACCGTCCTAGGTCAGCCCAAAAGCAGCCCATCCGTAACT CTGTTCCCACCTAGTTCAGAGGAGCTTCAAGCAACAAAGCCACACTTGTGTTGCCTTA TTAGTGATTTTTATCCCGGTGCCGTGACAGTTGCCTGGAAAGCTGATAGCTCACCAGT GAAAGCTGGCTGGGAGACAACCACCACCATCTAAACAAGCAATAACAAGTATGGTGCC AGCTCATATCTGAGTCTCACTCCAGAACAATGGAAGTCTCATCGGTCCTATAGCTGTC AAGTGACCACGAAGGCAGTACCGTGCGAGAGACCGTGGCCACCAGAGTGTAGC |
| 501 | NORI-033 | CDRH1 (IMGT) | Amino acid sequence of CDRH1 using IMGT | GDSISSHTYW |
| 502 | NORI-033 | CDRH2 (IMGT) | Amino acid sequence of CDRH2 using IMGT | MFYSGST |

-continued

| SEQ ID NO | | Description | Sequence |
|---|---|---|---|
| 503 | NORI-033 | CDRH3 (IMGT) | Amino acid sequence of CDRH3 using IMGT | ARHNNWGMENYFDD |
| 504 | NORI-033 | CDRH1 (KABAT) | Amino acid sequence of CDRH1 using Kabat | SHTYWWG |
| 505 | NORI-033 | CDRH2 (KABAT) | Amino acid sequence of CDRH2 using Kabat | SMFYSGSTYINPSLKS |
| 506 | NORI-033 | CDRH3 (KABAT) | Amino acid sequence of CDRH3 using Kabat | HNNWGMENYFDD |
| 507 | NORI-033 | Heavy chain variable region | Amino acid sequence of VH | QLQLQESGPGLVKPSETLSLTCTVSGDSISSHTYWWGWIRQPPGKGLEWIGSMFYSGS TYYNPSLKSRVVISVDTSRNQFSLKVRSVTAADTAVFYCARHNNWGMENYFDDWGQGT LVTVSS |
| 508 | NORI-033 | Heavy chain variable region | Nucleic acid sequence of VH | CAGCTCCAGCTGCAGGAGTCGGGCCCAGGACTGGTGAAGCCTTCGGAGACCCTGTCCC TCACCTGCACTGTCTCTGGTGACTCCATCAGTAGTCATACTTACTGGTGGGGCTGGAT CCGCCAGCCCCCAGGGAAGGGGCTGGAGTGGATTGGAGTATGTTTATAGTGGGAGC ACCTACTACAATCCGTCCCTCAAGAGTCGAGTCGTCATATCCGTAGACACGTCCAGGA ACCAGTTCTCCCTGAAAGTGAGGTCTGTGACCGCAGCACGGCTGTGTTTACTG TGCGAGACATAATAATTGGGAATGGAGAACTACTTTGACGACTGGGGCCAGGGAACC CTGGTCACCGTCTCCTCA |
| 509 | NORI-033 | Full heavy chain sequence | Amino acid sequence heavy chain | QLQLQESGPGLVKPSETLSLTCTVSGDSISSHTYWWGWIRQPPGKGLEWIGSMFYSGS TYYNPSLKSRVVISVDTSRNQFSLKVRSVTAADTAVFYCARHNNWGMENYFDDWGQGT LVTVSSASTKGPSVFPLAPCSRSTSESTAALGCLVKDYFPEPVTVSWNSGALTSGVHT FPAVLQSSGLYSLSSVVTVPSSSLGTKTYTCNVDHKPSNTKVDKRVESKYGPPCPPCP APEFEGGPSVFLFPPKPKDTLMISRTPEVTCVVVDVSQEDPEVQFNWYVDGVEVHNAK TKPREEQFNSTYRVVSVLTVLHQDWLNGKEYKCKVSNKGLPSSIEKTISAKGQPREP QVYTLPPSQEEMTKNQVSLTCLVKGFYPSDIAVEWESNGQPENNYKTTPPVLDSDGSF FLYSRLTVDKSRWQEGNVFSCSVMHEALHNHYTQKSLSLSLGK |
| 510 | NORI-033 | Full heavy chain sequence | Nucleic acid sequence heavy chain | CAGCTCCAGCTGCAGGAGTCGGGCCCAGGACTGGTGAAGCCTTCGGAGACCCTGTCCC TCACCTGCACTGTCTCTGGTGACTCCATCAGTAGTCATACTTACTGGTGGGGCTGGAT CCGCCAGCCCCCAGGGAAGGGGCTGGAGTGGATTGGAGTATGTTTATAGTGGGAGC ACCTACTACAATCCGTCCCTCAAGAGTCGAGTCGTCATATCCGTAGACACGTCCAGGA ACCAGTTCTCCCTGAAAGTGAGGTCTGTGACCGCAGCACGGCTGTGTTTACTG TGCGAGACATAATAATTGGGAATGGAGAACTACTTTGACGACTGGGGCCAGGGAACC CTGGTCACCGTCTCCTCAGCTAGCACCAAGGGCCCTTCCGTGTTCCCTGCCCCTT GCAGCAGGAGCACCTCCGAATCCACAGCTGCCCTGGGCTGTCTGGTGAAGGACTACTT TCCCGAGCCCGTGACCGTGAGCTGGAACTCCGGCGCTCTGACATCCGGCGTCCACACC TTTCCTGCCGTCCTGCAGTCCTCCGGCCTCTACCTCCGTGTCCCGGTGACCGTGC CTAGCTCCTCCCTGGACACCAAGACCTACACCTGTAACGTGGACCACAAACCCTCCAA CACCAAGGTGGACAAACGGGTCGAGAGCAAGTACGGCCCTCCCTGCCCTCCTTGTCCT GCCCCGAGTTCGAAGGCGGACCCAGCGTGTTCCTGTTCCCTCCTAAGCCCAAGGACA CCCTCATGATCAGCCGGACACCCGAGGTGACCTGCGTGGTGGATGTGAGCCAGGA GGACCCTGAGGTCCAGTTCAACTGGTATGTGGATGGCGTGGAGGTGCACAACGCCAAG ACAAAGCCCCGGGAAGAGCAGTTCAACTCCACCTACAGGGTGGTCAGCGTGCTGACCG TGCTGCATCAGGACTGGCTGAACGGCAAGGAGTACAAGTGCAAGGTCAGCAATAAGGG |

-continued

| SEQ ID NO | | Description | Sequence |
|---|---|---|---|
| | | | ACTGCCCAGCAGCATCGAGAGACCATCTCCAAGGCTAAAGGCCAGCCCCGGAACCT CAGGTGTACACCCTGCCTCCCAGCCAGGAGGATGACCAAGAACCAGGTGAGCCTGA CCTGCCTGGTCAAGGGATTCTACCCTTCCGACATCGCCGTGGAGTGGGAGTCCAACGG CCAGCCCGAGAACAATTATAGACACCACCCTCCCGTCCTGGACAGCGACGATCCTTC TTTCTGTACTCCAGGCTGACCGTGGATAAGTCCAGTGGCGAGGAAGGCAACGTGTTCA GCTGCTCCGTGATGCACGAGGCCCTGCACAATCACTACACCCAGAAGTCCCTGAGCCT GTCCCTGGGAAAG |
| 287 | NORI-033 | Amino acid sequence of CDRL1 using IMGT | ALPDQY |
| | | CDRL1 (IMGT) | |
| 288 | NORI-033 | Amino acid sequence of CDRL2 using IMGT | KDS |
| | | CDRL2 (IMGT) | |
| 511 | NORI-033 | Amino acid sequence of CDRL3 using IMGT | QSADSSGSYW |
| | | CDRL3 (IMGT) | |
| 512 | NORI-033 | Amino acid sequence of CDRL1 using KABAT | SADALPDQYGY |
| | | CDRL1 (KABAT) | |
| 291 | NORI-033 | Amino acid sequence of CDRL2 using KABAT | KDSERPS |
| | | CDRL2 (KABAT) | |
| 511 | NORI-033 | Amino acid sequence of CDRL3 using KABAT | QSADSSGSYW |
| | | CDRL3 (KABAT) | |
| 513 | NORI-033 | Amino acid sequence of VL | SYALTQPPSVSVSPGQTARITCSADALPDQYGYWYQQKPGQAPVLVIYKDSERPSGIP ERFSGSSSGTTVTLTIISGVQAEDEADYYCQSADSSGSYWFGGGTKLTVL |
| | | Light chain variable region | |
| 514 | NORI-033 | Nucleic acid sequence of VL | TCCTATGCGCTGACACAGCCACCCTCGGTGTCCCAGGACAGACGGGCCAGGA TCACCTGCTCTGCAGATGCATTGCCCAGACCAATATGGTTACCAGGTACCAGAGAGCC AGGCCAGGCCCCTGGTCTGCTGGTGATATATAAAGACAGTGAGAGGCCCTCAGGGATCCCT GAGCGGTTCTCTGGCTCCAGCTCAGGGACAACAGACTCACGTTGACCATCAGTGGAGTCC AGGCAGAAGACGAGGCTGACTATTACTGTCAATCAGCAGACAGCAGTGGTTCTTATGT GGTATTCGGCGGAGGGACCAAGCTGACCGTCCTA |
| | | Light chain variable region | |
| 515 | NORI-033 | Amino acid sequence light chain | SYALTQPPSVSVSPGQTARITCSADALPDQYGYWYQQKPGQAPVLVIYKDSERPSGIP ERFSGSSSGTTVTLTIISGVQAEDEADYYCQSADSSGSYVVFGGGTKLTVLGQPKAAPS VTLFPPSSEELQANKATLVCLISDFYPGAVTVAWKADSSPVKAGVETTTPSKQSNNKY AASSYLSLTPBQWKSHRSYSCQVTHEGSTVEKTVAPTECS |
| | | Full light chain sequence | |
| 516 | NORI-033 | Nucleic acid sequence light chain | TCCTATGCGCTGACACAGCCACCCTCGGTGTCCCAGGACAGACGGGCCAGGA TCACCTGCTCTGCAGATGCATTGCCCAGACCAATATGGTTACCAGGTACCAGAGAGCC AGGCCAGGCCCCTGGTCTGCTGGTGATATATAAAGACAGTGAGAGGCCCTCAGGGATCCCT GAGCGGTTCTCTGGCTCCAGCTCAGGGACAACAGACTCACGTTGACCATCAGTGGAGTCC AGGCAGAAGACGAGGCTGACTATTACTGTCAATCAGCAGACAGCAGTGGTTCTTATGT GGTATTCGGCGGAGGGACCAAGCTGACCGTCCTAGGTCAGCCCAAAGCAGCCCCATCC GTAACTCTGTTCCCACCTAGTTCAGGAGGAGCTTCAAGCCAAACAAAGCCACACTTGTTT GCCTTATTAGTGATTTTATCCCGGTGCCGTGACAGTTGCCTGACAGCTGATAGCTC |
| | | Full light chain sequence | |

| SEQ ID NO | | Description | Sequence |
|---|---|---|---|

517

Human IgG1 constant region

IGHG1*01

ACCAGTGAAAGCTGGCGTGAGACAACACCACCATCTAAACAAAGCAATAACAAGTAT
GCTGCCAGCTCATATCTGAGTCTCACTCCAGAACAATGAAGTCTCATCGGTCCTATA
GCTGTCAAGTGACCCACGAAGGCAGTACCGTCGAGAGACCGTGGCACCCACAGAGTG
TAGC

Human Heavy Chain Constant Region (IGHG1*01) Nucleotide Sequence gcctccaccaagggccatcggtcttccccctggcaccctcctccaagagcacctctg
gggcacagcggccctgggctgcctggtcaaggactacttcccggaaccggtgacggt
gtcgtggaactcaggcgccctgaccagcggcgtgcacaccttcccggctgtcctacag
tcctcaggactcactctgagcagcgtggtgaccgtgccctccagcagcttgggcac
cccagacctacatctgcaacgtgaatcacaagcccagcaacaccaaggtggacaagaa
agttgagcccaaatctgtgacaaaactcacacatgcccaccgtgcccagcacctgaa
ctcctggggggaccgtcagtcttcctcttccccccaaaacccaaggacaccctcatga
tctcccggacccctgaggtcacatgcgtggtggtggacgtgagccacgaagaccctga
ggtcaagttcaactggtacgtggacggcgtggaggtgcataatgccaagacaaagccg
cgggaggagcagtacaacagcacgtaccgtgtggtcagcgtcctcaccgtcctgcacc
cccatcgagcagaaaaccatctccaaagccaaaggtctgaccagggaaccacaggtgtac
accctgcccccatcccgggatgagctgaccaagaaccaggtcagcctgacctgcctgg
tcaaaggcttctatcccagcgacatcgccgtggagtgggagagcaatgggcagccgga
gaacaactacaagaccacgcctcccgtgctggactccgacggctccttcttcctctac
agcaagctcaccgtggacaagagcaggtggcagcaggggaacgtcttctcatgctccg
tgatgcatgaggctctgcacaaccactacacgcagaagagcctctccctgtctccggg
taaa

518

Human Heavy Chain Constant Region (IGHG1*01) Protein Sequence (P01857)

ASTKGPSVFPLAPSSKSTSGGTAALGCLVKDYFPEPVTVSWNSGALTSGVHTFPAVLQ
SSGLYSLSSVVTVPSSSLGTQTYICNVNHKPSNTKVDKKVEPKSCDKTHTCPPCPAPE
LLGGPSVFLFPPKPKDTLMISRTPEVTCVVVDVSHEDPEVKFNWYVDGVEVHNAKTKP
REEQYNSTYRVVSVLTVLHQDWLNGKEYKCKVSNKALPAPIEKTISKAKGQPREPQVY
TLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK

519

Human IgG1 constant region

IGHG1*02 or IGHG1*05

Human Heavy Chain Constant Region (IGHG1*02 or IGHG1*05) Nucleotide Sequence gcctccaccaagggccatcggtcttccccctggcaccctcctccaagagcacctctg
gggcacagcggccctgggctgcctggtcaaggactacttcccggaaccggtgacggt
gtcgtggaactcaggcgccctgaccagcggcgtgcacaccttcccggctgtcctacag
tcctcaggactcactctgagcagcgtggtgaccgtgccctccagcagcttgggcac
cccagacctacatctgcaacgtgaatcacaagcccagcaacaccaaggtggacaagaa
agttgagcccaaatctgtgacaaaactcacacatgcccaccgtgcccagcacctgaa
ctcctggggggaccgtcagtcttcctcttccccccaaaacccaaggacaccctcatga
tctcccggacccctgaggtcacatgcgtggtggtggacgtgagccacgaagaccctga
ggtcaagttcaactggtacgtggacggcgtggaggtgcataatgccaagacaaagccg
cgggaggagcagtacaacagcacgtaccgtgtggtcagcgtcctcaccgtcctgcacc
cccatcgagcagaaaaccatctccaaagccaaaggtctgaccagggaaccacaggtgtac
accctgcccccatcccgggatgagctgaccaagaaccaggtcagcctgacctgcctgg
tcaaaggcttctatcccagcgacatcgccgtggagtgggagagcaatgggcagccgga
gaacaactacaagaccacgcctcccgtgctggactccgacggctccttcttcctctac
agcaagctcaccgtggacaagagcaggtggcagcaggggaacgtcttctcatgctccg
tgatgcatgaggctctgcacaaccactacacgcagaagagcctctccctgtctccggg
taaa

520

Human Heavy Chain Constant Region

A S T K G P S V F P L A P S S K S T S G G T A A L G C L V
K D Y F P E P V T V S W N S G A L T S G V H T F P A V L Q

-continued

| SEQ ID NO | Description | Sequence |
|---|---|---|
| | (IGHG1*02) Protein Sequence | S S G L Y S L S S V V T V P S S S L G T Q T Y I C N V N H<br>K P S N T K V D K K V E P K S C D K T H T C P P C P A P E<br>L L G G P S V F L F P P K P K D T L M I S R T P E V T C V<br>V V D V S H E D P E V K F N W Y V D G V E V H N A K T K P<br>R E E Q Y N S T Y R V V S V L T V L H Q D W L N G K E Y K<br>C K V S N K A L P A P I E K T I S K A K G Q P R E P Q V Y<br>T L P P S R D E L T K N Q V S L T C L V K G F Y P S D I A<br>V E W E S N G Q P E N N Y K T T P P V L D S D G S F F L Y<br>S K L T V D K S R W Q Q G N V F S C S V M H E A L H N H Y<br>T Q K S L S P G K |
| 521 | Human IgG1 constant region<br><br>IGHG1*03<br><br>Human Heavy Chain Constant Region (IGHG1*03) Nucleotide Sequence (Y14737) | gcctccaccaagggcccatcggtcttccccctggcaccctcctccaagagcacctctg<br>gggcacagcggccctgggctgcctggtcaaggactacttccccgaaccggtgacggt<br>gtcgtggaactcaggcgccctgaccagcggcgtgcacaccttcccggctgtcctacag<br>tcctcaggactctactccctcagcagcgtgaccgtgccctccagcagcttgggca<br>cccagacctacatctgcaacgtgaatcacaagcccagcaacaccaaggtggacaagag<br>agttgagcccaaatcttgtgacaaaactcacacatgcccaccgtgcccagcacctgaa<br>ctcctggggggaccgtcagtcttcctcttccccccaaaaccaaggacaccctcatga<br>tctcccggacccctgaggtcacatgcgtggtggtggacgtgagccacgaagaccctga<br>ggtcaagttcaactggtacgtggacggcgtggaggtgcataatgccaagacaaagccg<br>cgggaggagcagtacaacagcacgtaccgtgtggtcagcgtcctcaccgtcctgcacc<br>aggactggctgaatggcaaggagtacaagtgcaaggtctccaacaaagccctcccagc<br>ccccatcgagaaaaccatctccaaagccaaagggcagccccgagaaccacaggtgtac<br>accctgcccccatcccgggaggagatgaccaagaaccaggtcagcctgacctgcctgg<br>tcaaaggcttctatcccagcgacatcgccgtggagtgggagagcaatgggcagccgga<br>gaacaactacaagaccacgcctcccgtgctggactccgacggctccttcttcctctat<br>agcaagctcaccgtggacaagagcaggtggcagcaggggaacgtcttctcatgctccg<br>tgatgcatgaggctctgcacaaccactacacgcagaagagcctctccctgtctccggg<br>taaa |
| 522 | Human IgG1 constant region<br><br>IGHG1*03<br><br>Human Heavy Chain Constant Region (IGHG1*03) Protein Sequence | A S T K G P S V F P L A P S S K S T S G G T A A L G C L V<br>K D Y F P E P V T V S W N S G A L T S G V H T F P A V L Q<br>S S G L Y S L S S V V T V P S S S L G T Q T Y I C N V N H<br>K P S N T K V D K K V E P K S C D K T H T C P P C P A P E<br>L L G G P S V F L F P P K P K D T L M I S R T P E V T C V<br>V V D V S H E D P E V K F N W Y V D G V E V H N A K T K P<br>R E E Q Y N S T Y R V V S V L T V L H Q D W L N G K E Y K<br>C K V S N K A L P A P I E K T I S K A K G Q P R E P Q V Y<br>T L P P S R E E M T K N Q V S L T C L V K G F Y P S D I A<br>V E W E S N G Q P E N N Y K T T P P V L D S D G S F F L Y<br>S K L T V D K S R W Q Q G N V F S C S V M H E A L H N H Y<br>T Q K S L S P G K |
| 523 | Human IgG1 constant region<br><br>IGHG1*04<br><br>Human Heavy Chain Constant Region (IGHG1*04) Nucleotide Sequence | gcctccaccaagggcccatcggtcttccccctggcaccctcctccaagagcacctctg<br>gggcacagcggccctgggctgcctggtcaaggactacttccccgaaccggtgacggt<br>gtcgtggaactcaggcgccctgaccagcggcgtgcacaccttcccggctgtcctacag<br>tcctcaggactctactccctcagcagcgtgaccgtgccctccagcagcttgggca<br>cccagacctacatctgcaacaaatcttgtgacaaaactcacacatgcccaccgtgcccagcagcacctgaa<br>agttgagcccaaatcttgtgacaaaactcacacatgcccaccgtgcccagcacctgaa<br>ctcctggggggaccgtcagtcttcctcttccccccaaaaccaaggacaccctcatga<br>tctcccggacccctgaggtcacatgcgtggtggtggacgtgagccacgaagaccctga |

-continued

| SEQ ID NO | Description | Sequence |
|---|---|---|
| | | ggtcaagttcaactggtacgtggacggcgtggaggtgcataatgccaagacaaagccg cggggaggagcagtacaacagcacgtaccgtgtggtcagcgtcctcaccgtcctgcacc aggactggctgaatggcaaggagtacaagtgcaaggtctccaacaaagccctcccagc cccatcgagaaaaccatctccaaagccaaagggcagccccgagaaccacaggtgtac accctgcccccatcccgggatgagctgaccaagaaccaggtcagcctgacctgcctgg tcaaaggcttctatcccagcgacatcgccgtggagtgggagagcaatgggcagccgga gaacaactacaagaccacgcctcccgtgctggactccgacggctccttcttcctctac agcaagctcaccgtggacaagagcaggtggcagcaggggaacatcttctcatgctccg tgatgcatgaggctctgcacaaccactacacgcagaagagcctctccctgtctccggg taaa |
| 524 | Human Heavy Chain Constant Region (IGHG1*04) Protein Sequence | ASTKGPSVFPLAPSSKSTSGGTAALGCLVKDYFPEPVTVSWNSGALTSGVHTFPAVLQ SSGLYSLSSVVTVPSSSLGTQTYICNVNHKPSNTKVDKKVEPKSCDKTHTCPPCPAPE LLGGPSVFLFPPKPKDTLMISRTPEVTCVVVDVSHEDPEVKFNWYVDGVEVHNAKTKP REEQYNSTYRVVSVLTVLHQDWLNGKEYKCKVSNKALPAPIEKTISKAKGQPREPQVY TLPPSRDELTKNQVSLTCLVKGFYPSDIAVEWESNGQPENNYKTTPPVLDSDGSFFLY SKLTVDKSRWQQGNIFSCSVMHEALHNHYTQKSLSLSPGK |
| 525 | Disabled human IGHG1*01 | Disabled Human IGHG1*01 Heavy Chain Constant Region Nucleotide Sequence. |
| | | gcctccaccaagggcccatcggtcttccccctggcaccctcctccaagagcacctctg gggcacagcggccctgggctgcctggtcaaggactacttccccgaaccggtgacggt gtcgtggaactcaggcgccctgaccagcggcgtgcacaccttcccggctgtcctacag tcctcaggactctactccctcagcagcgtgaccgtgccctccagcagcttgggcaccaga cccagcacctacatctgcaacgtgaatcacaagcccagcaacaccaaggtggacaagaa agtggagcccaaatcttgtgacaaaactcacacatgcccaccgtgcccagcaccctgaa ctcgcggggggaccgtcagtcttcctcttccccccaaaacccaaggacaccctcatga tctcccggacccctgaggtcacatgcgtggtggtggacgtgagccacgaagaccctga ggtcaagttcaactggtacgtggacggcgtggaggtgcataatgccaagacaaagccg cgggaggagcagtacaacagcacgtaccgtgtggtcagcgtcctcaccgtcctgcacc aggactggctgaatggcaaggagtacaagtgcaaggtctccaacaaagccctcccagc cccatcgagaaaaccatctccaaagccaaagggcagccccgagaaccacaggtgtac accctgcccccatcccgggatgagctgaccaagaaccaggtcagcctgacctgcctgg tcaaaggcttctatcccagcgacatcgccgtggagtgggagagcaatgggcagccgga gaacaactacaagaccacgcctcccgtgctggactccgacggctccttcttcctctac agcaagctcaccgtggacaagagcaggtggcagcaggggaacgtcttctcatgctccg tgatgcatgaggctctgcacaaccactacacgcagaagagcctctccctgtctccggg taaa |
| 526 | | Disabled Human IGHG1*01 Heavy Chain Constant Region Amino Acid Sequence. Two residues that differ from the wild-type sequence are identified in bold. |
| | | ASTKGPSVFPLAPSSKSTSGGTAALGCLVKDYFPEPVTVSWNSGALTSGVHTFPAVLQ SSGLYSLSSVVTVPSSSLGTQTYICNVNHKPSNTKVDKKVEPKSCDKTHTCPPCPAPE LAGAPSVFLFPPKPKDTLMISRTPEVTCVVVDVSHEDPEVKFNWYVDGVEVHNAKTKP REEQYNSTYRVVSVLTVLHQDWLNGKEYKCKVSNKALPAPIEKTISKAKGQPREPQVY TLPPSRDELTKNQVSLTCLVKGFYPSDIAVEWESNGQPENNYKTTPPVLDSDGSFFLY SKLTVDKSRWQQGNVFSCSVMHEALHNHYTQKSLSLSPGK |
| 527 | IGHG2*01 or IGHG2*05 | Human Heavy Chain Constant Region (IGHG2*01 or IGHG2*03 or IGHG2*05) Nucleotide Sequence |
| | | gcctccaccaagggcccatcggtcttcccccctggcgccctgctccaggagcacctccg agagcacagcggccctgggctgcctggtcaaggactacttccccgaaccggtgacggt gtcgtggaactcaggcgctctgaccagcggcgtgcacaccttcccagcagtcctacag tcctcaggactctactccctcagcagcgtggtgaccgtgccctccagcaacttcggca cccagacctacacctgcaacgtagatcacaagcccagcaacaccaaggtggacaagac agttgagcgcaaatgttgtgtcgagtgcccaccgtgcccagcaccacctgtggcagga ccgtcagtcttcctcttccccccaaaaacccaaggacaccctcatgatctcccggaccc |

-continued

| SEQ ID NO | Description | Sequence |
|---|---|---|
| | | ctgaggtcacgtcgtggtggtggacgtggagcgtgagccacgaagacccgaggtccagttcaa<br>ctggtacgtggacggcgtggaggtgcataatgcctccaagacgcacagcccacaggactggctga<br>ttcaacagcacgttccgtgtggtcagcgtcctcaccgttgtgcaccaggactggctga<br>acggcaaggagtacaagtgcaaggtctccaacaaaggcctcccagcccccatcgagaa<br>aaccatctccaaaaccaaaggacagccccgagaaccacaggtgtacaccctgcccccca<br>tcccgggaggagatgaccaagaaccaggtcagcctgacctgcctggtcaaaggcttct<br>acccagcgacatcgccgtggagtgggagagcaatgggcagccggagaacaactacaa<br>gttacacagcaggaggacggaaccggctctccctcttctctacagcaagctcacc<br>gtggacaagagcaggtggcagcaggggaacgtcttctcatgctccgtgatgcatgagg<br>ctctgcacaaccactacacgcagaagagcctctccctgtctccgggtaaa |
| 528 | IGHG2*04 or<br><br>Human Heavy Chain<br>Constant Region<br>(IGHG2*01) Protein<br>Sequence | ASTKGPSVFPLAPCSRSTSESTAALGCLVKDYFPEPVTVSWNSGALTSGVHTFPAVLQ<br>SSGLYSLSSVVTVPSSNFGTQTYTCNVDHKPSNTKVDKTVERKCCVECPCPAPPVAG<br>PSVFLFPPKPKDTLMISRTPEVTCVVVDVSHEDPEVQFNWYVDGVEVHNAKTKPREEQ<br>FNSTFRVVSVLTVVHQDWLNGKEYKCKVSNKGLPAPIEKTISKTKGQPREPQVYTLPP<br>SREEMTKNQVSLTCLVKGFYPSDIAVEWESNGQPENNYKTTPPMLDSDGSFFLYSKLT<br>VDKSRWQQGNVFSCSVMHEALHNHYTQKSLSLSPGK |
| 529 | Human IgG2<br>constant<br>region<br><br>IGHG2*02<br><br>Human Heavy Chain<br>Constant Region<br>(IGHG2*02) Nucleotide<br>Sequence | GCCTCCACCAAGGGCCCATCGGTCTTCCCCCTGGCGCCCTGCTCCAGGAGCACCTCCG<br>AGAGCACAGCGGCCCTGGGCTGCCTGGTCAAGGACTACTTCCCCGAACCGGTGACGGT<br>GTCGTGGAACTCAGGCGCTCTGACCAGCGGCGTGCACACCTTCCCGGCTGTCCTACAG<br>TCCTCAGCAGCTTCACTCCCTCCAGCAGCGTGGTGACCGTGCCCTCCAGCAACTTCGGCA<br>CCCAGACCTACACCTGCAACGTAGATCACAAGCCCAGCAACACCAAGGTGGACAAGAC<br>AGTTGAGCGCAAATGTTGTGTCGAGTGCCCACCGTGCCCAGCACCACCTGTGGCAGGA<br>CCGTCAGTCTTCCTCTTCCCCCCAAAACCCAAGGACACCCTCATGATCTCCCGGACCC<br>CTGAGGTCACGTGCGTGGTGGTGGACGTGAGCCAGAAGACCCCGAGGTCCAGTTCAA<br>CTGGTACGTGGACGGCGTGGAGGTGCATAATGCCAAGACAAAGCCACGGGAGGAGCAG<br>TTCAACAGCACGTTCCGTGTGGTCAGCGTCCTCACCGTCCTGCACCAGGACTGGCTGA<br>ACGGCAAGGAGTACAAGTGCAAGGTCTCCAACAAAGGCCTCCCAGCCCCCATCGAGAA<br>AACCATCTCCAAAACCAAAGGACAGCCCCGAGAACCACAGGTGTACACCCTGCCCCCA<br>TCCCGGGAGGAGATGACCAAGAACCAGGTCAGCCTGACCTGCCTGGTCAAAGGCTTCT<br>ACCCCAGCGACATCGCCGTGGAGTGGGAGAGCAATGGGCAGCCGGAGAACAACTACAA<br>GACCACACCTCCCATGCTGGACTCCGACGGCTCCTTCTTCCTCTACAGCAAGCTCACC<br>GTGGACAAGAGCAGGTGGCAGCAGGGGAACGTCTTCTCATGCTCCGTGATGCATGAGG<br>CTCTGCACAACCACTACACACAGAAGAGCCTCTCCCTGTCTCCGGGTAAA |
| 530 | Human Heavy Chain<br>Constant Region<br>(IGHG2*02) Protein<br>Sequence | ASTKGPSVFPLAPCSRSTSESTAALGCLVKDYFPEPVTVSWNSGALTSGVHTFPAVLQ<br>SSGLYLSSVVTVTVTPSSNFGTQTYTCNVDHKPSNTKVDKTVERKCCVECPCPAPPVAG<br>PSVFLFPPKPKDTLMISRTPEVTCVVVDVSHEDPEVQFNWYVDGMEVHNAKTKPREEQ<br>FNSTFRVVSVLTVVHQDWLNGKEYKCKVSNKGLPAPIEKTISKTKGQPREPQVYTLPP<br>SREEMTKNQVSLTCLVKGFYPSDIAVEWESNGQPENNYKTTPPMLDSDGSFFLYSKLT<br>VDKSRWQQGNVFSCSVMHEALHNHYTQKSLSLSPGK |
| 531 | Human IgG2<br>constant<br>region<br><br>IGHG2*04<br><br>Human Heavy Chain<br>Constant Region<br>(IGHG2*04) Nucleotide<br>Sequence | gcctccaccaagggcccatcggtcttcccccctggcgccctgctccaggagcacctccg<br>agagcacagcggccctgggctgcctggtcaaggactacttccccgaaccggtgacggt<br>gtcgtggaactcaggcgctctgaccagcggcgtgcacaccttccccggctgtcctacag<br>tcctcaggactctactccctccagcagcgtggtgaccgtgccctccagcagcttgggca<br>cccagacctacacctgcaacgtagatcacaagcccagcaacaccaaggtggacaagac<br>agttgagcgcaaatgttgtgtcgagtgcccaccgtgcccagcaccacctgtggcagga<br>ccgtcagtcttcctcttccccccaaaacccaaggacaccctcatgatctcccggaccc<br>ctgaggtcacgtgcgtggtggtggacgtgagccacgaagaccccgaggtccagttcaa<br>ctggtacgtggacggcgtggaggtgcataatgccaagacaaagccacgggaggagcag |

-continued

| SEQ ID NO | Description | Sequence |
|---|---|---|
| | | ttcaacagcagcgttccgttggtcagcgtctccaccgttgtgcaccaggactggctga<br>acggcaaggagtacaagtgcaaggtctccaacaaaggcctcccagcccccatcgagaa<br>aaccatctccaaaaccaaaggccagcccgagaaccacaggtgtacacctgcccca<br>tcccggaggagatgaccaagaaccaggtcagcctgacctgcctggtcaaaggcttct<br>accccagcgacatcgccgtggagtgggagagcaatgggcagccggagaacaactaca<br>gaccacacctcccatgctggactccgacggctccttcttcctctacagcaagctcacc<br>gtggacaagagcaggtggcagcaggggaacgtcttctcatgctccgtgatgcatgagg<br>ctctgcacaaccactacacgcagaagagcctctccctgtctccgggtaaa |
| 532 | Human Heavy Chain Constant Region (IGHG2*04) Protein Sequence | ASTKGPSVFPLAPCSRSTSESTAALGCLVKDYFPEPVTVSWNSGALTSGVHTFPAVLQ<br>SSGLYSLSSVVTVPSSLGTQTYTCNVDHKPSNTKVDKTVERKCCVECPPCPAPPVAG<br>PSVFLFPPKPKDTLMISRTPEVTCVVVDVSHEDPEVQFNWYVDGVEVHNAKTKPREEQ<br>FNSTFRMVSLTWHQDWLNGKEYKCKVSNKGLPAPIEKTISKTKGQPREPQVYTLPP<br>SREEMTKNQVSLTCLVKGFYPSDIAVEWESNGQPENNYKTTPPMLDSDGSFFLYSKLT<br>VDKSRWQQGNVFSCSVMHEALHNHYTQKSLSLSPGK |
| 533 | Human IgG2 constant region<br>IGHG2*06<br><br>Human Heavy Chain Constant Region (IGHG2*06) Nucleotide Sequence | GCCTCCACCAAGGGCCCATCGGTCTTCCCCCTGGCGCCCTGCTCCAGGAGCACCTCCG<br>AGAGCACAGCGGCCCTGGGCTGCCTGGTCAAGGACTACTTCCCCGAACCGGTGACGGT<br>GTCGTGGAACTCAGGCGCCTTGACCAGCGGCGTGCACACCTTCCCGGCTGTCCTACAG<br>TCCTCAGGACTCTACTCCCTCAGCAGCGTGGTGACCGTGCCCTCAGCAACTTCGGCA<br>CCCAGACCTACACCTGCAACGTAGATCACAAGCCCAGCAACACCAAGGTGGACAAGAC<br>AGTTGAGCGCAAATGTTGTGCGAGGTGCCCACCGTGCCCAGCACCACCTGTGGCAGGA<br>CCGTCAGTCTTCCTCTTCCCCCCAAAACCCAAGGACACCCTCATGATCTCCCGGACCC<br>CTGAGGTCACGTGCGTGGTGGTGGACGTGAGCCACGAAGACCCCGAGGTCCAGTTCAA<br>TTCAACACGTTCCGTGGTGAGCGTCCTCACCGTCCTGCACCAGGACTGGCTGA<br>ACGGCAAGGAGTACAAGTGCAAGGTCTCCAACAAAGGCCTCCCAGCCCCCATCGAGAA<br>AACCATCTCCAAAACCAAAGGCCAGCCCCGAGAACCACAGGTGTACACCCTGCCCCCA<br>TCCCGGGAGGAGATGACCAAGAACCAGGTCAGCCTGACCTGCCTGGTCAAAGGCTTCT<br>ACCCCAGCGACATCTCCGTGGAGTGGGAGAGCAATGGGCAGCCGGAGAACAACTACAA<br>GACCACACCTCCCATGCTGGACTCCGACGGCTCCTTCTTCCTCTACAGCAAGCTCACC<br>GTGGACAAGAGCAGGTGGCAGCAGGGGAACGTCTTCTCATGCTCCGTGATGCATGAGG<br>CTCTGCACAACCACTACACGCAGAAGAGCCTCTCCCTGTCTCCGGGTAAA |
| 534 | Human Heavy Chain Constant Region (IGHG2*06) Protein Sequence | ASTKGPSVFPLAPCSRSTSESTAALGCLVKDYFPEPVTVSWNSGALTSGVHTFPAVLQ<br>SSGLYSLSSVVTVPSSNFGTQTYTCNVDHKPSNTKVDKTVERKCCVECPPCPAPPVAG<br>PSVFLFPPKPKDTLMISRTPEVTCVVVDVSHEDPEVQFNWYVDGVEVHNAKTKPREEQ<br>FNSTFRMVSLTWHQDWLNGKEYKCKVSNKGLPAPIEKTISKTKGQPREPQVYTLPP<br>SREEMTKNQVSLTCLVKGFYPSDISVEWESNGQPENNYKTTPPMLDSDGSFFLYSKLT<br>VDKSRWQQGNVFSCSVMHEALHNHYTQKSLSLSPGK |
| 535 | IGHG4*01 or IGHG4*04<br><br>Human IgG4 constant region (IGHG4*01 or IGHG4*04) Nucleotide Sequence | gcttccaccaagggcccatccgtcttccccctgggcccctgctccaggagcacctccg<br>agagcacagccgccctgggctgcctggtcaaggactacttccccgaaccggtgacggt<br>gtcgtggaactcaggcgccctgaccagcggcgtgcacaccttcccggctgtcctacag<br>tcctcaggactctactccctcagcagcgtggtgaccgtgccctccagcagcttgggca<br>cgaagacctacacctgcaacgtagatcacaagcccagcaacaccaaggtggacaagag<br>agttgagtccaaatatggtcccccatgcccaccatgcccagcacctgagctcctgggg<br>ggaccatcagtcttcctgttccccccaaaacccaaggacactctcatgatctcccgga<br>cccctgaggtcacgtgcgtggtggtggacgtgagccaggaagaccccgaggtccagtt<br>caactggtacgtggatggcgtggaggtgcataatgccaagacaaagccgcgggaggag<br>cagttcaacagcacgtaccgtgtggtcagcgtcctcaccgtcctgcaccaggactggc<br>tgaacggcaaggagtacaagtgcaaggtctccaacaaagcctccaacaaaggcctcccatcga |

-continued

| SEQ ID NO | Description | Sequence |
|---|---|---|
| | | gaaaaccatctccaaagcccaaagggcagcccgagacccacaggtgtacaccctgccc<br>ccatcccaggaggagatgaccaagaaccaggtcagcctgacctgcctggtcaaagct<br>tctacccccagcgacatcgccgtggagtgggagagcaatgggcagccggagaacaacta<br>caagaccacgcctcccgtgctggactccgacggctccttcttcctctacagcaggcta<br>accgtggacaagagcaggtggcaggaggggaatgtcttctcatgctccgtgatgcatg<br>aggctctgcacaaccactacacgcagaagagcctctccctgtctccgggtaaa |
| 536 | Human Heavy Chain Constant Region (IGHG4*01) Protein Sequence (P01861) | ASTKGPSVFPLAPCSRSTSESTAALGCLVKDYFPEPVTVSWNSGALTSGVHTFPAVLQ<br>SSGLYSLSSVVTVPSSSLGTKTYTCNVDHKPSNTKVDKRVESKYGPPCPSCPAPEFLG<br>GPSVFLFPPKPKDTLMISRTPEVTCVVVDVSQEDPEVQFNWYVDGVEVHNAKTKPREE<br>QFNSTYRVVSVLTVLHQDWLNGKEYKCKVSNKGLPSSIEKTISKAKGQPREPQVVTLP<br>PSQEEMTKNQVSLTCLVKGFYPSDIAVEWESNGQPENNYKTTPPVLDSDGSFFLYSRL<br>TVDKSRWQEGNVFSCSVMHEALHNHYTQKSLSLSLGK |
| 537 | IGHG4*02 Human IgG4 constant region Human Heavy Chain Constant Region (IGHG4*02) Nucleotide Sequence | gcttccaccaaggcccatccgtcttcccccctggcgccctgctccaggagcacctccg<br>agagcacaggcccccctgggctgcctggtcaaggactacttcccccgaaccggtgacggt<br>gtcgtggaactccaggcgccctgaccagcggcgtgcacaccttccggctgtcctacag<br>tcctcaggactctactccctcagcagcgtggtgaccgtgccctccagcagcttgggca<br>cgaagacctacacctgcaacgtagatcacaagcccagcaacaccaaggtggacaagag<br>agttgagtccaaatatggtcccccgtgcccatcatgcccagcacctgagttcctgggg<br>ggaccatcagtcttcctgttcccccaaaacccaaggacactctcatgatctcccgga<br>cccctgaggtcacgtgcgtggtggtggacgtgagccacgaagaccccgaggtccagtt<br>caactggtacgtggacggcgtggaggtgcataatgccaagacaaagccgcgggaggag<br>cagttcaacagcacgtaccgtgtggtcagcgtcctcaccgtcctgcaccaggactggc<br>tgaacggcaaggagtacaagtgcaaggtctccaacaaaggcctcccgtcctccatcga<br>ccatcccaggaggagatgaccaagaaccaggtcagcctgacctgcctggtcaaaggct<br>tctacccccagcgacatcgccgtggagtgggagagcaatgggcagccggagaacaacta<br>caagaccacgcctcccgtgctggactccgacggctccttcttcctctacagcaggcta<br>aaccgtggacaagagcaggtggcaggaggggaatgtcttctcatgctccgtgatgcatg<br>aggctctgcacaaccactacacgcagaagagcctctccctgtctccgggtaaa |
| 538 | Human Heavy Chain Constant Region (IGHG4*02) Protein Sequence | ASTKGPSVFPLAPCSRSTSESTAALGCLVKDYFPEPVTVSWNSGALTSGVHTFPAVLQ<br>SSGLYSLSSVVTVPSSSLGTKTYTCNVDHKPSNTKVDKRVESKYGPPCPSCPAPEFLG<br>GPSVFLFPPKPKDTLMISRTPEVTCVVVDVSQEDPEVQFNWYVDGVEVHNAKTKPREE<br>QFNSTYRVVSVLTVWHQDWLNGKEYKCKVSNKGLPSSIEKTISKAKGQPREPQVYTLP<br>PSQEEMTKNQVSLTCLVKGFYPSDIAVEWESNGQPENNYKTTPPVLDSDGSFFLYSRL<br>TVDKSRWQEGNVFSCSVMHEALHNHYTQKSLSLSLGK |
| 539 | IGHG4*03 Human IgG4 constant region Human Heavy Chain Constant Region (IGHG4*03) Nucleotide Sequence | gcttccaccaaggcccatctcgtctcccccctggcgccctgctccaggagcacctccg<br>agagcacaggcccccctgggctgcctggtcaaggactacttcccccgaaccggtgacggt<br>gtcgtggaactccaggcgccctgaccagcggcgtgcacaccttccggctgtcctacag<br>tcctcaggactctactccctcagcagcgtgtgaccgtgccctccagcagcttgggca<br>cgaagacctacacctgcaacgtagatcacaagcccatcaacaccaaggtggacaagag<br>agttgagtccaaatatggtcccccatgcccatcatgcccagcacctgagttcctgggg<br>ggaccatcagtcttcctgttcccccaaaacccaaggacactctcatgatctcccgga<br>cccctgaggtcacgtgcgtggtggtggacgtgagccacgaagaccccgaggtccagtt<br>caactggtacgtggacggcgtggaggtgcataatgccaagacaaagccgcgggaggag<br>cagttcaacagcacgtaccgtgtggtcagcgtcctcaccgtcctgcaccaggactggc<br>tgaacggcaaggagtacaagtgcaaggtctccaacaaaggcctcccgtcctccatcga<br>gaaaaccatctccaaagccaaagggcagccccgagaaccacaggtgtacaccctgccc<br>ccatcccaggaggagatgaccaagaaccaggtcagcctgacctgcctggtcaaaggct |

-continued

| SEQ ID NO | | Description | Sequence |
|---|---|---|---|
| 540 | | Human Heavy Chain Constant Region (IGHG4*03) Protein Sequence | tctacccagcgacatcgcctgtgggtgggagagcaatggcagccggagaacaacta caagaccacgcctcccgtgctggactccgacggctccttcttcctcacagcaagctc accgtggacaagagcaggtggcaggaggggaacgtcttctcatgctccgtgatgcatg aggctctgcacaaccactacacgcagaagagcctctccctgtctctgggtaaa ASTKGPSVFPLAPCSRSTSESTAALGCLVKDYFPEPVTVSWNSGALTSGVHTFPAVLQ SSGLYSLSSVVTVPSSSLGTKTYTCNVDHKPSNTKVDKRVESKYGPPCPSCPAPEFLG GPSVFLFPPKPKDTLMISRTPEVTCVVVDVSQEDPEVQFNWYVDGVEVHNAKTKPEE QFNSTYRVVSVLTVLHQDWLNGKEYKCKVSNKGLPSSIEKTISKAKGQPREPQVTLP PSQEEMTKNQVSLTCLVKGFYPSDIAVEWESNGQPENNYKTTPPVLDSDGSFFLYSKL TVDKSRWQEGNVFSCSVMHEALHNHYTQKSLSLSLGK |
| 541 | IGHG4-PE Human IgG4-PE constant region | Human Heavy Chain Constant Region (IGHG4-PE) Nucleotide Sequence Version A | gcctccaccaagggcccatccgtcttccccctggcgccctgctccaggagcacctccg agagcacctccgagagcaccgccgctgtcaaggactacttcccccgaaccagtgacggt gtcgtggaactcaggcgccctgaccagcggcgtgcacaccttcccggctgtcctacag tcctcaggactctactccctcagcagcgtggtgaccgtgccctccagcagcttgggca cgaagacctacatctgcaacgtagatcacaagcccagcaacaccaaggtggacaagag agttgagtccaaatatggtcccccatgcccaccatgcccagcacctgaatttgagggg ggaccatcagtcttcctgttccccccaaaacccaaggacactctcatgatctcccga ccctgaggtcacgtgcgtggtggtggacgtgagccacgaagaccccgaggtccagtt caactggtacgtggacggcgtggaggtgcataatgccaagacaaagccgcgggaggag cagttcaacagcacgtaccgtgtggtcagcgtcctcaccgtcctgcaccaggactggc tgaacggcaaggagtacaagtgcaaggtctccaacaaaggcctcccgtcatcgtca gaaaaccatccaaaagccaaaggcagccccgagaaccacaggtgtacaccctgccc ccatcccaggagagatgaccaagaaccaggtcagcctgacctgcctggtcaaaggct tctacccccagcgacatcgcctggagtgggagagcaatggcagccggagaacaacta caagaccacgcctcccgtgctggactccgacggatcttcttcctctacagcaggcta accgtggacaagagcaggtggcaggaggggaatgtcttctcatgctccgtgatgcatg aggctctgcacaaccactacacacagaagagcctctccctgtctctgggtaaa |
| 542 | IGHG4-PE | Human Heavy Chain Constant Region (IGHG4-PE) Nucleotide Sequence Version B | gcctccaccaagggaccaagggacctagcgtgttccccctgttccaggtccacaagcg agtccaccagcgagtccaccgctgccctgggctgtctggtgaaagactacttcccgagccccgtgaccgt ctcctggaatagcggagccctgaccctgcccgtgtggtgacacacattccgcgtgctgcag agcagcggactgtatagcctgagcagcgtggtgaccgtgccccagtccagcctcggca ccaaaacctacacctgcaacgtggaccacaagcctccaacaccaaggtggacaagcg ggtggagagccaatatggccccccctgcccccctgtcctgccacctgaatttgagggga ggacctccgtgttcctgttccccccaaaacccaaggacaccctgatgatctcccga caccctgaggtgacctgcgtggtggtggacgtgagccaggaagaccccgaggtccagtt caactggtatgtggacggcgtggaggtgcacaatgccaagaccaagccgcagggaggag cagttcaattccacccaccgggtggtggagtgcacaagtgctaccgtgtggtcagcgtcctcaccgtcctgcaccaggattggc tgaacggcaaggagtacaagtgcaaggtgtccaacaaaggactgcccagctccatcga gaagaccatcagcaaggccaagggacagcccagagagccccaggtgtatacctgcct cacccaggaggagatgaccaagaaccaggtcagcctgacctgtctggtgaagggat tctaccccagcgacatcgccgtggagtgggagagcaatgggcagcccgagaacacta caaaacaaccctctccgtgctggactccgatggctcatccttcctgttcctacagcggtg acagtggacaagagcaggtggcaggagggcaacgtcttcccctgttccgtgatgcacg aggccctgcacaatcactacacccagaagagcctctccctgtctccgggcaag |
| 543 | IGHG4-PE Inactivated IGHG4 Human IgG4-PE constant region | Human Heavy Chain Constant Region (IGHG4-PE) Nucleotide Sequence Version C | gccagcaccaagggcccttccgtgttccccctggcccctgagcaggagcacctccg aatccacagagtcgcctggcgtctggtgaaggactacttcccgagccccgtgaccgt gagctggaacagcggcgcctggaccatccggcgtgcacaccttctgccctgcag tcctccggcctactccctgagcagcgtggtgaccgtgccctctagcctcggca |

-continued

| SEQ ID NO | Description | Sequence |
|---|---|---|
| | Inactivated Human IgG4 constant region | ccaagacctacacctgaacgtggacaccaaacccteccacaccaaggtgacaaacg<br>ggtcgagacaagtacggccctcccttgcctcctcctcgtctgcccggagttcgaaggc<br>ggaccagccgtgttcctgccctcctaagccaaggacaccctcatgatcagccgga<br>caccgaggtgaccgtggatgtgtagatgagcaagacgcaagaggaccctgagtccagtt<br>caactgtatggacgtggggagatgcacaccgacgtgtgagccagcaagccccggaagag<br>cagttcaactccacctacagggtggtcagcgtgctcgaccgtgctgcatcaggactggc<br>tgaacgcaaggagtacaagtgcaaggtcagcaataaggagctaaaggactgccagcatcga<br>gaagaccatctcaaggctcaaaggccaaggtgtacaccctgcct<br>cccagccaggaggagatgaccaagaaccaggtggaggtggctgcggagggat<br>tctacctctccgacatcgccgtggagtgggagagcaatgggcagccggagaacaatta<br>taagaccacccctcccgtgctgacagcgacggatctccttttctgtactccaggctg<br>accgtggataagtcagttgacgtgacaagtcaacgtgttcagctgctccgtgatgcacg<br>aggccctgcacaatcactacacacagaagtccctgagcctgtcccctgggaaag |
| 544 | Human Heavy Chain Constant Region (IGHG4-PE) Protein Sequence (Amino acid substitution shown in BOLD) | ASTKGPSVFPLAPCSRSTSESTAALGCLVKDYFPEPVTVSWNSGALTSGVHTFPAVLQ<br>SSGLYSLSSVVTVPSSSLGTKTYTCNVDHKPSNTKVDKRVESKYGPPCPCPAPEFEG<br>GPSVFLPPKPKDTLMISRTPEVTCVVVDVSQEDPEVQFNWYVDGVEVHNAKTKPREE<br>QFNSTYRVVSVLTVLHQDWLNGKEYKCKVSNKGLPSSIEKTISKAKGQPREPQVYTLP<br>PSQEEMTKNQVSLTCLVKGFYPSDIAVEWESNGQPENNYKTTPPVLDSDGSFFLYSRL<br>TVDKSRWQEGNVFSCSVMHEALHNHYTQKSLSLGK |
| 545 | Inactivated Human Heavy Chain Constant Region (IGHG4) Nucleotide Sequence | gcctccaccaagggcccatccgtcttccccctggcgccctgctccaggagcacctccg<br>agagcacggccgccctgggctgcctggtcaaggactacttcccgaaccagtgacggt<br>gtcgtggaactccaggcgccctgaccagcggcgtgcacacctttcccggctgtcctacag<br>tcctcaggactctactcctcagcagcgtggtgaccgtgccctccagcagcttgggca<br>cgaagacctacacctgcaacgtagatcacaagcccagcaacaccaaggtggacaagag<br>agttgagtccaaatatggtcccccatgcccaccatgcccagcacctgagtgggg<br>ggaccatcagtcttcctgttcccccccaaaacccaaggacactctcatgatctcccgga<br>ccccctgaggtcacgtgcgtggtggtggacgtgagccacgaagaccccgaggtccagtt<br>caactggtacgtggatggcgtggaggtgcataatgccaagacaaagccgcgggaggag<br>cagttcaacagcacgtaccgtgtggtcagcgtcctcaccgtcctgcaccaggactggc<br>tgaacggcaaggagtacaagtgcaaggtctccaacaaaggcctcccgtcatcgatcga<br>gaaaaccatctccaaagccaaagggcagccccgagagccacaggtgtaccaccctgccc<br>ccatcccaggaggagatgaccaagaaccaggtcagcctgacctgcctggtcaaaggct<br>tctaccccagcgacatcgccgtggagtgggagagcaatgggcagccggagaacaacta<br>caagaccacgcctcccgtgctggactccgacggctccttcttcctctacagcaggcta<br>accgtggacaagagcaggtggcagcaggggaacgtcttctcatgctccgtgatgcatg<br>aggctctgcacaaccactacacacagaagagcctctccctgtctccgggtaaa |
| 546 | Inactivated Human Heavy Chain Constant Region (IGHG4) Protein Sequence (inactivating mutations from human IgG4 shown in bold) | ASTKGPSVFPLAPCSRSTSESTAALGCLVKDYFPEPVTVSWNSGALTSGVHTFPAVLQ<br>SSGLYSLSSVVTVPSSSLGTKTYTCNVDHKPSNTKVDKRVESKYGPPCPCPAPPVAG<br>GPSVFLPPKPKDTLMISRTPEVTCVVVDVSQEDPEVQFNWYVDGVEVHNAKTKPREE<br>QFNSTYRVVSVLTVLHQDWLNGKEYKCKVSNKGLPSSIEKTISKAKGQPREPQVYTLP<br>PSQEEMTKNQVSLTCLVKGFYPSDIAVEWESNGQPENNYKTTPPVLDSDGSFFLYSRL<br>TVDKSRWQEGNVFSCSVMHEALHNHYTQKSLSLGK |
| 547 | IGKC*01 | Human Cκ Light Chain Constant Region (IGKC*01) Nucleotide Sequence | cgtacggtggccgcccctccgtgttcatcttccacctttccgacgagcagctgaagt<br>cggtcaccgccttctgtcgtgcctgctgaacaacttctacccagagcccgaggccaggt<br>gcagtggaaggtggacaacgccctccaatcccaggagagcgtcgaggaatccgtgaccgag<br>caggacctccaagacagcaccctactccctgtcctccaccctgacctgcagggcg<br>actacgagaagcacaaggtgtacgcctgcgaagtgacccaccagggcctcttagcccc<br>cgtgaccaagtcttcaacgggggaggtgt |

-continued

| SEQ ID NO | Description | Sequence |
|---|---|---|
| 548 | Cκ Light Chain Constant Region (IGKC*01) Amino Acid Sequence | RTVAAPSVFIFPPSDEQLKSGTASVVCLLNNFYPREAKVQWKVDNALQSGNSQESVTE QDSKDSTYSLSSTLTLSKADYEKHKVYACEVTHQGLSSPVTKSFNRGEC |
| 549 | Human Cκ constant region IGKC*02 Cκ Light Chain Constant Region (IGKC*02) Nucleotide Sequence | cgaactgtggctgcaccatctgtcttcatcttcccgccatctgatgagcagttgaaat ctggaactgcctctgttgtgtgcctgctgaataacttctatcccagagaggccaaagt acagtggaaggtggataacgccctccaatcgggtaactcagcaggagagtgtcacagag caggacagcaaggacagcacctacagcctcagcagcaccctgacgctgagcaaagcag actacgagaaacacaaagtctacgcctgcgaagtcacccatcagggcctgagctcgcc cgtcacaaagagcttcaacaggggagagtgt |
| 550 | Cκ Light Chain Constant Region (IGKC*02) Amino Acid Sequence | RTVAAPSVFIFPPSDEQLKSGTASVVCLLNNFYPREAKVQWKVDNALQSGNSQESVTE QESKDSTYSLSSTLTLSKADYEKHKVYAGEVTHQGLSSPVTKSFNRGEC |
| 551 | Human Cκ constant region IGKC*03 Cκ Light Chain Constant Region (IGKC*03) Nucleotide Sequence | cgaactgtggctgcaccatctgtcttcatcttcccgccatctgatgagcagttgaaat ctggaactgcctctgttgtgtgcctgctgaataacttctatcccagagaggccaaagt acagtggaaggtggataacgccctccaatcgggtaactcagcaggagagtgtcacagag caggacagcaaggacagcacctacagcctcagcagcaccctgacgctgagcaaagcag actacgagaaacacaaagtctacgcctgcgaagtcacccatcagggcctgagctcgcc cgtcacaaagagcttcaacaggggagagtgt |
| 552 | Cκ Light Chain Constant Region (IGKC*03) Amino Acid Sequence | RTVAAPSVFIFPPSDEQLKSGTASVVCLLNNFYPREAKVQRKVDNALQSGNSQESVTE QESKDSTYSLSSTLTLSKADYEKHKVYACEVTHQGLSSPVTKSFNRGEC |
| 553 | Human Cκ constant region IGKC*04 Cκ Light Chain Constant Region (IGKC*04) Nucleotide Sequence | cgaactgtggctgcaccatctgtcttcatcttcccgccatctgatgagcagttgaaat ctggaactgcctctgttgtgtgcctgctgaataacttctatcccagagaggccaaagt acagtggaaggtggataacgccctccaatcgggtaactcagcaggagagtgtcacagag caggacagcaaggacagcacctacagcctcagcagcaccctgacgctgagcaaagcag actacgagaaacacaaactctacgcctgcgaagtcacccatcagggcctgagctcgcc cgtcacaaagagcttcaacaggggagagtgt |
| 554 | Cκ Light Chain Constant Region (IGKC*04) Amino Acid Sequence | RTVAAPSVFIFPPSDEQLKSGTASVVCLLNNFYPREAKVQWKVDNALQSGNSQESVTE QDSKDSTYSLSSTLTLSKADYEKHKLYACEVTHQGLSSPVTKSFNRGEC |
| 555 | Human Cκ constant region IGKC*05 Cκ Light Chain Constant Region (IGKC*05) Nucleotide Sequence | cgaactgtggctgcaccatctgtcttcatcttcccgccatctgatgagcagttgaaat ctggaactgcctctgttgtgtgcctgctgaataacttctatcccagagaggccaaagt acagtggaaggtggataacgccctccaatcgggtaactcagcaggagagtgtcacagag caggacagcaaggacagcacccccgacgctgagcaaagcag actacgagaaacacaaagtctacgcctgcgaagtcacccatcagggcctgagctcgcc cgtcacaaagagcttcaacaggggagagtgc |
| 556 | Cκ Light Chain Constant Region (IGKC*05) Amino Acid Sequence | RTVAAPSVFIFPPSDEQLKSGTASVVCLLNNFYPREAKVQWKVDNALQSGNSQESVTE QDSKDSTYSLSNTLTLSKADYEKHKVYACEVTHQGLSSPVTKSFNRGEC |
| 557 | Human Cλ constant region IGLC1*01 Cλ Light Chain Constant Region (IGLC1*01) Nucleotide Sequence (ENST00000390321.2) | cccaggccaccccacggtcactcttgttcccgccctcctctgaggagctccaagcca acaaggccacactagtgtgtctgatcagtgacttcaccccgagctgacagtggc ttggaaggcagatggcagccccgtcaaggcgggagtggagacgaccaaacctccaaa cagagcaacaacaagtacgcggccagcagctacctgagcctgacgcccgagcagtgga agtcccacagaagccacagtccaggtcacgcatgaagggagcaccgtggagaagac agtggcccctacagaatgttca |

-continued

| SEQ ID NO | | Description | Sequence |
|---|---|---|---|
| 558 | | Cλ Light Chain Constant Region (IGLC1*01) Amino Acid Sequence (A0A075B6K8) | PKANPTVTLFPPSSEELQANKATLVCLISDFYPGAVTVAWKADGSPVKAGVETTKPSK QSNNKYAASSYLSLTPEQWKSHRSYSCQVTHEGSTVEKTVAPTECS |
| 559 | | Human Cλ constant region | IGLC1*02 | Cλ Light Chain Constant Region (IGLC1*02) Nucleotide Sequence Version A | ggtcagcgcccaaggccaacccactgtcactctgttcccgccctcctctgaggagctcc aagccaacaaggccacactagtgtctgatcagtgacttctaccgggagctgtgac agtggcctggaaggcagatggcagcccgtcaaggcgggagtggagaccaccaaaccc tccaaacagacagcaacaacaagtacgcggccagctgcgcagtggcctgacgcccgagc agtggaagtccacagcagctacagctacctgagcctgacgcccgtgga gaagacagtggccctacagaatgtca |
| 560 | | | Cλ Light Chain Constant Region (IGLC1*02) Nucleotide Sequence Version B | ggtcagcgcccaaggccaacccactgtcactctgttcccgccctcctctgaggagctcc aagccaacaaggccacactagtgtctgatcagtgacttctaccgggagctgtgac agtggcctggaaggcagatggcagcccgtcaaggcgggagtggagaccaccaaaccc tccaaacagacagcaacaacaagtacgcggccagctgcgcagtggcctgacgcccgagc agtggaagtccacagcagctacagctacctgagcctgacgcccgtgga gaagacagtggccctacagaatgtca |
| 561 | | Human Cλ constant region | IGLC1*02 | Cλ Light Chain Constant Region (IGLC1*02) Amino Acid Sequence | GQPKANPTVTLFPPSSEELQANKATLVCLISDFYPGAVTVAWKADGSPVKAGVETTKP SKQSNNKYAASSYLSLTPEQWKSHRSYSCQVTHEGSTVAPTECS |
| 562 | | Human Cλ constant region | IGLC2*01 | Cλ Light Chain Constant Region (IGLC2*01) Nucleotide Sequence Version A | ggccagcgcctaaggccgctccttctgtgacccgtctccccatcctccgaggaactgc aagctaacaaggccacactccgtgtcctgatcagcgactctctaccctggcgtgtgac cgtggcctggaaggtgatagctccctgtgaaggccaggctggaacccaccaccct tccaagcagtccaacaacaaatacgccgcctccaaccgcctgagcctgacccctgagc agtggaagagccacagaagctacagctgccagctgacccacgagggctcccacgtgga aaagaccgtggctcctacggtgtcc |
| 563 | | | Cλ Light Chain Constant Region (IGLC2*01) Nucleotide Sequence Version B | ggccagcgcctaaggctgccccagctgacccaccctgttctcctcctcagcgaggagctcc aggccaacaaggccacctcgtgtgcctgatcagctgctgctatccggcgtgtgac cgtggcttggaaggcgacttcaaagcgcctggagaccaccaccaccct tccaagcagtccaacaacaagtacgccgcctccagctatctctccctgacccctgagc agtggaagtccacagcagctacactcctgtcaggtgaccacgagggctcccacgtgga aaagaccgtggcccccacggagtgctcc |
| 564 | IGLC2*01 IGLC2*02 or IGLC2*03 | Human Cλ constant region | Cλ Light Chain Constant Region (IGLC1*02) Amino Acid Sequence | GQPKAAPSVTLFPPSSEELQANKATLVCLISDFYPGAVTVAWKADSSPVKAGVETTTP SKQSNNKYAASSYLSLTPEQWKSHRSYSCQVTHEGSTVEKTVAPTECS |
| 565 | | Human Cλ constant region | Cλ Light Chain Constant Region (IGLC2*02 or IGLC2*03) Nucleotide Sequence | ggtcagcgcccaaggccgctccccctgtcctctgttcccgccctcctctgaggagcttc aagccaacaaggccacactggtgtctcataagtgacttctaccgggagccgtgac agtgcctggaaggcagatagcagcccgtcaaggcggagccagctatctgagcctgagc agtggaagtccacagcagctacagctgccagctgacccacgagggagcaccgtgga gaagacagtggccctacagaatgtca |
| 564 | | Human Cλ constant region | Cλ Light Chain Constant Region (IGLC2*02) Amino Acid Sequence | GQPKAAPSVTLFPPSSEELQANKATLVCLISDFYPGAVTVAWKADSSPVKAGVETTTP SKQSNNKYAASSYLSLTPEQWKSHRSYSCQVTHEGSTVEKTVAPTECS |
| 566 | | Human Cλ constant region | IGLC3*01 | Cλ Light Chain Constant Region (IGLC3*01) Nucleotide Sequence | cccaaggctgccccctcggtcactctgttcccaccctctctgaggagcttcaagcca acaaggccacactggtgtctcataagtgacttctaccgggagccgtgacagttgc ctggagaaggcagatagcagcccctgcaaggcggggtggaggtggagaccaccaccctccaaa |

-continued

| SEQ ID NO | Description | Sequence |
|---|---|---|
| 567 | Cλ Light Chain Constant Region (IGLC3*01) Amino Acid Sequence | caaagcaacacaagtacggcgcagcagctacctgagcctgacgctgagcagtgga agtcccacaaaagctacagctgccaggtcacgcatgaagggagcaccgtggagaagac agttgccctcacggatgttca PKAAPSVTLFPPSSEELQANKATLVCLISDFYPGAVTVAWKADSSPVKAGVETTTPSK QSNNKYAASSYLSLTPEQWKSHKSYSCQVTHEGSTVEKTVAPTECS |
| 568 | Human Cλ constant region IGLC3*02 Cλ Light Chain Constant Region (IGLC3*02) Nucleotide Sequence | ggtcagcccaaggctgcccctcggtcactctgtccaccctcctctgaggagcttc aagccaacaaggccacactggtgtgtctcataagtgacttctacccgggcgcagtgac agttgcctggaaggcagatagcagccctgtcaaggcgggggtggagaccacacaccc tccaacaaagcaacaagtacagctacaagtgccagcagctcaccgaggagctgagc agtggaagtccaacaaagctacacagctcaggtcacgcatgaagggagcaccgtgga gaagacagtggcccctacggaatgttca GQPKAAPSVTLFPPSSEELQANKATLVCLISDFYPGPVTVAWKADSSPVKAGVETTTP SKQSNNKYAASSYLSLTPEQWKSHKSYSCQVTHEGSTVEKTVAPTECS |
| 569 | Cλ Light Chain Constant Region (IGLC1*02) Amino Acid Sequence | |
| 570 | Human Cλ constant region IGLC3*03 Cλ Light Chain Constant Region (IGLC3*03) Nucleotide Sequence | ggtcagcccaaggctgcccctcggtcactctgtccaccctcctctgaggagcttc aagccaacaaggccacactggtgtgtctcataagtgacttctacccgggcgcagtgac agtgcctggaaggcagatagcagccctgtcaaggcgggagtggagaccacacaccc tccaacaaagcaacaagtacagctacaagtgccagcagtcgcacgcatgaagggagcaccgtgga gaagacagtggcccctacagaatgttca GQPKAAPSVTLFPPSSEELQANKATLIVCLISDFYPGAVTVAWKADSSPVKAGVETTTP SKQSNNKYAASSYLSLTPEQWKSHKSYSCQVTHEGSTVEKTVAPTECS |
| 571 | Cλ Light Chain Constant Region (IGLC3*03) Amino Acid Sequence | |
| 572 | Human Cλ constant region IGLC3*04 Cλ Light Chain Constant Region (IGLC3*04) Nucleotide Sequence | ggtcagcccaaggctgcccctcggtcactctgtccgccctcctctgaggagcttc aagccaacaaggccacactggtgtgtctcataagtgacttctacccgggagccgtgac agtgcctggaaggcagatagcagccctgtcaaggcgggagtggagaccacacaccc tccaacaaagcaacaagtacagctacaagtgccagcagtcgcacgcatgaagggagcaccgtgga gaagacagtggcccctacagaatgttca GQPKAAPSVTLFPPSSEELQANKATLVCLISDFYPGAVTVAWKADSSPVKAGVETTTP SKQSNNKYAASSYLSLTPEQWKSHRSYSCQVTHEGSTVEKTVAPTECS |
| 564 | Cλ Light Chain Constant Region (IGLC3*04) Amino Acid Sequence | |
| 573 | Human Cλ constant region IGLC6*01 Cλ Light Chain Constant Region (IGLC6*01) Nucleotide Sequence | ggtcagcccaaggctgcccccatcggtcactctgtccgccctcctctgaggagcttc aagccaacaaggccacactggtgcctgatcagtcagggagctgtgaa agtgcctggaaggcagatgcagccctgtcaacacgggagctgcccagctcacgcctgagc agtggaagtccaacaaagctacacagctcaccgaggagctgagc agtgcctggaaggcagatgcagccctgtcaacacggagctgagc agtggaagtccaacaaagctacacagctcaggtcacgcatgaagggagcaccgtgga gaagacagtggcccctgcagaatgttca GQPKAAPSVTLFPPSSEELQANKATLVCLISDFYPGAVKVAWKADGSPVNTGVETTTP SKQSNNKYAASSYLSLTPEQWKSHRSYSCQVTHEGSTVEKTVAPACS |
| 574 | Cλ Light Chain Constant Region (IGLC6*01) Amino Acid Sequence | |
| 575 | Human Cλ constant region IGLC7*01 or IGLC7*02 Cλ Light Chain Constant Region (IGLC7*01 or IGLC7*02) Nucleotide | ggtcagcccaaggctgcccatcggtcactctgtccaccctcctctgaggagcttc aagccaacaaggccacactggtgtctcgtaagtgacttctacccgggagccgtgac agtgcctggaaggcagatggcagccccgtcaaggtgggagtggagaccaccaaccc |

-continued

| SEQ ID NO | | Description | Sequence |
|---|---|---|---|
| | | Sequence | tccaaacaaagcaacaacaagtatgcggcagcagcctgacctgacgcccgagc<br>agtggaagtcccacagaagaagtacagctgcgggtcacgcatgaaggagcaccgtgga<br>gaagcagtggcccctgcagaatgctct |
| 576 | | CA Light Chain Constant Region (IGLC7*01) Amino Acid Sequence | GQPKAAPSVTLFPPSSEELQANKATLVCLVSDFYPGAVTVAWKADGSPVKVGVETTKP<br>SKQSNNKYAASSYLSLTPEQWKSHRSYSCRVTHEGSTVEKTVAPAECS |
| 577 | IGLC7*03 | CA Light Chain Constant Region (IGLC7*03) Nucleotide Sequence | GGTCAGCCCAAGGCTGCCCCCTCGGTCACTCTGTTCCCACCCTCCTCGAGGAGCTTC<br>AAGCCAACAAGCCCACACTGGTGTGTCTGGTAAGTGACTTCAACCCGGGAGCCGTGAC<br>AGTGGCCTGGAAGGCAGATGGCAGCCCCGTCAAGGTGGGAGTGGAGACCACCAAACCC<br>TCCAAACAAAGCAACAACAAGTATGCGGCCAGCAGCTACCTGAGCCTGACGCCCGAGC<br>AGTGGAAGTCCCACAGAAGCTACAGCTGCCGGGTCACGCATGAAGGGAGCACCGTGGA<br>GAAGACAGTGGCCCCTGCAGAATGCTCT |
| 578 | Human CA constant region | CA Light Chain Constant Region (IGLC7*03) Amino Acid Sequence | GQPKAAPSVTLFPPSSEELQANKATLVCLVSDFNPGAVTVAWKADGSPVKVGVETTKP<br>SKQSNNKYAASSYLSLTPEQWKSHRSYSCRVTHEGSTVEKTVAPAECS |
| 579 | IGHG4-PE IGHG4-PE | Human Heavy Chain Constant Region (IGHG4-PE) Nucleotide Sequence (lysine clipped) | GCTTCTACCAAGGGACCCAGCGTGTTCCCTCTGGCTCCTTGCTCCAGATCCACCTCCG<br>AGTCTACAGTGTCTTGGGCTGCCTGGTCAAGGACTACTTTCCTGAGCCTGTGACCGT<br>GTCTTGGAACTCTGGCGCTCTGACATCTGGCGTGCACACATTCCCTGCTGCTGCAG<br>TCCTCCGGCCTGTACTCTCTGTCCTCGTGCAAGACCTTCCAACACCAAGGTGGGCA<br>CCAAGACCTACACCTGTAATGTGGACCACAAGCCTTCCAACACCAAGGTGGACAAGCG<br>CGTGGAATCTAAGTACGGCCCCTCCTTGTCCCTCCAAAGCCTAAGGACACACCCTGATGATCTCTCGGA<br>CCCCTGAAGTGACCTGCGTGGTGGTGATGTGTCCCAAGGAGGATCCCGAGGTCAGTT<br>CAATTGGTACGTGGACGGCGTGGAAGTGCACAACGCCAAGACCAAGCCTAGAGAGGAA<br>CAGTTCAACTCCACCTACAGATGTGTCCGTGCTGACCGTGCTGCACCAGGATTGGC<br>TGAACGGCAAAGAGTACAAGTGCAAGGTCTCAACAAGGGCCTGCCTAGCTCCATCGA<br>AAAGACCATCTCAAGGCCAGGGCCAGCCTCGAGAACCCCAGGTTTACACCCTGCCT<br>CCAAGCAAGAGGAAATGACCAAGAACCAGGTGTCCCTGACCTGCCTCGTGAAGGGAT<br>TCTACCCCTCCGATATCGCCGTGGAATGGAGTCTAATGGCCAGCCAGAGAACAACTA<br>CAAGACAACCCCTCCTGTGCTGGACTCCGACGGCTCCTTCTTTCTGTATTCCCGCCTG<br>ACCGTGGACAAGTCCAGATGGCAAGAGGGCAACGTGTTCTCCTGCAGCGTGATGCACG<br>AGGCCCTGCACAATCACTACACCCAGAAGTCCCTGTCTCTGTCCCTGGGC |
| 580 | | Human Heavy Chain Constant Region (IGHG4-PE) Protein Sequence (lysine clipped) | ASTKGPSVFPLAPCSRSTSESTAALGCLVKDYFPEPVTVSWNSGALTSGVHTFPAVLQ<br>SSGLYSLSSVVTVPSSSLGTKTYTCNVDHKPSNTKVDKRVESKYGPPCPCPAPEFEG<br>GPSVFLFPPKPKDTLMISRTPEVTCVVVDVSQEDPEVQFNWYVDGVEVHNAKTKPREE<br>QFNSTYRVVSVLTVLHQDWLNGKEYKCKVSNKGLPSSIEKTISKAKGQPREPQVYTLP<br>PSQEEMTKNQVSLTCLVKGFYPSDIAVEWESNGQPENNYKTTPPVLDSDGSFFLYSRL<br>TVDKSRWQEGNVFSCSVMHEALHNHYTQKSLSLSLG |

SEQUENCE LISTING (580 sequences)

SEQ ID NO: 1 - protein, 855 aa, Homo sapiens [sequence omitted]

SEQ ID NO: 2 - protein, 811 aa, Homo sapiens
MLLLFHSKRMPVAEAPQVAGGQGDGGDGEEAEPEGMFKACEDSKRKARGYLRLVPLFVLLALLVLASAGVLLWYFLGYKAEVMVSQVYSGSLRVLNRHFSQDLTRRESSAFRSETAKAQKMLKELITSTRLGTYYNSSSVYSFGEGPLTCFFWFILQIPEHRRLMLSPEVVQALLVEELLSTVNSSAAVPYRAEYEVDPEGLVILEASVKDIAALNSTLGCYRYSYVGQGQVLRLKGPDHLASSCLWHLQGPKDLMLKLRLEWTLAECRDRLAMYDVAGPLEKRLITSVYGCSRQEPVVEVLASGAIMAVVWKKGLHSYYDPFVLSVQPVVFQACEVNLTLDNRLDSQGVLSTPYFPSYYSPQTHCSWHLTVPSLDYGLALWFDAYALRRQKYDLPCTQGQWTIQNRRLCGLRILQPYAERIPVVATAGITINFTSQISLTGPGVRVHYGLYNQSDPCPGEFLCSVNGLCVPACDGVKDCPNGLDERNCVCRATFQCKEDSTCISLPKVCDGQPDCLNGSDEEQCQEGVPCGTFTFQCEDRSCVKKPNPQCDGRPDCRDGSDEEHCDCGLQGPSSRIVGGAVSSEGEWPWQASLQVRGRHICGGALIADRWVITAAHCFQEDSMASTVLWTVFLGKVWQNSRWPGEVSFKVSRLLLHPYHEEDSHDYDVALLQLDHPVVRSAAVRPVCLPARSHFFEPGLHCWITGWGALREGGPISNALQKVDVQLIPQDLCSEVYRYQVTPRMLCAGYRKGKKDACQGDSGGPLVCKALSGRWFLAGLVSWGLGCGRPNYFGVYTRITGVISWIQQVVT

SEQ ID NO: 3 - protein, 843 aa, Homo sapiens
MDKENSDVSAAPADLKISNISVQVVSAQKKLPVRRPPLPGRRLPLPGRRPPQRPIGKAKPKKQSKKKVPFWNVQNKIILFTVFLFILAVIAWTLLWLYISKTESKDAFYFAGMFRITNIEFLPEYRQKESREFLSVSRTVQQVINLVYTTSAFSKFYEQSVVADVSSNNKGGLLVHFWIVFVMPRAKGHIFCEDCVAAILKDSIQTSIINRTSVGSLQGLAVDMDSVVLNAGLRSDYSSTIGSDKGCSQYFYAEHLSLHYPLEISAASGRLMCHFKLVAIVGYLIRLSIKSIQIEADNCVTDSLTIYDSLLPIRSSILYRICEPTRTLMSFVSTNNLMLVTFKSPHIRRLSGIRAYFEVIPEQKCENTVLVKDITGFEGKISSPYYPSYYPPKCKCTWKFQTSLSTLGIALKFYNYSITKKSMKGCEHGWWEINEHMYCGSYMDHQTIFRVPSPLVHIQLQCSSRLSDKPLLAEYGSYNISQPCPVGSFRCSSGLCVPQAQRCDGVNDCFDESDELFCVSPQPACNTSSFRQHGPLICDGFRDCENGRDEQNCTQSIPCNNRTFKCGNDICFRKQNAKCDGTVDCPDGSDEEGCTCSRSSSALHRIIGGTDTLEGGWPWQVSLHFVGSAYCGASVISREWLLSAAHCFHGNRLSDPTPWTAHLGMYVQGNAKFVSPVRRIVVHEYYNSQTFDYDIALLQLSIAWPETLKQLIQPICIPPTGQRVRSGEKCWVTGWGRRHEADNKGSLVLQQAEVELIDQTLCVSTYGIITSRMLCAGIMSGKRDACKGDSGGPLSCRRKSDGKWILTGIVSWGHGSGRPNFPGVYTRVSNFVPWIHKYVPSLL

SEQ ID NO: 4 - protein, 811 aa, Mus Musculus
MPRCFQLPCSTRMPTTEVPQAADGQGDAGDGEEAAEPEGKFKPPKNTKRKNRDYVRFTPLLLVLAALVSAGVMLWYFLGYKAEVTVSQVYSGSLRVLNRHFSQDLGRRESIAFRSESAKAQKMLQELVASTRLGTYYNSSSVYSFGEGPLTCFFWFILDIPEYQRLTLSPEVVRELLVDELLSNSSTLASYKTEYEVDPEGLVILEASVNDIVVLNSTLGCYRYSYVNPGQVLPLKGPDQQTTSCLWHLQGPEDLMIKVRLEWTRVDCRDRVAMYDAAGPLEKRLITSVYGCSRQEPVMEVLASGSVMAVVWKKGMHSYYDPFLLSVKSVAFQDCQVNLTLEGRLDTQGFLRTPYYPSYYSPSTHCSWHLTVPSLDYGLALWFDAYALRRQKYNRLCTQGQWMIQNRRLCGFRTLQPYAERIPMVASDGVTINFTSQISLTGPGVQVYYSLYNQSDPCPGEFLCSVNGLCVPACDGIKDCPNGLDERNCVCRAMFQCQEDSTCISLPRVCDRQPDCLNGSDEEQCQEGVPCGTFTFQCEDRSCVKKPNPECDGQSDCRDGSDEQHCDCGLQGLSSRIVGGTVSSEGEWPWQASLQIRGRHICGGALIADRWVITAAHCFQEDSMASPKLWTVFLGKMRQNSRWPGEVSFKVSRLFLHPYHEEDSHDYDVALLQLDHPVVYSATVRPVCLPARSHFFEPGQHCWITGWGAQREGGPVSNTLQKVDVQLVPQDLCSEAYRYQVSPRMLCAGYRKGKKDACQGDSGGPLVCREPSGRWFLAGLVSWGLGCGRPNFFGVYTRVTRVINWIQQVLT

SEQ ID NO: 5 - protein, 811 aa, Rattus norvegicus
MPRCFQLPCSTRMPTAEVPQAAGGQGDGGDGEEAAEPEGVFKAPRNAKRKDRDYVRFTPLLLVLAALASAGVMLWYFLGYKAEVTISQVYSGSLRVLNRHFSQDLARRESIAFRTETAKAQKMFQELVASTRLGTYYNSSSIYAFGEGPLICFFWFILDIPEYQRLTLSPEVVRELLVGELLSNSSALASYRTEYEVDPEGLVILEASVNDIVVLNSTLGCYRYSYVNPGQVLRLRGPDQQTTSCLWHLQGPEDLMLKVQLEWTRVDCRDRVAMYDAAGPLEKRLITSVYGCSRQEPVMEVLASGSVMAVVWKKGLHSFYDPFLLSVKSVAFQDCQVNLTLEGRLDPQGFLRTPYYPSYYSPSTHCSWHLTVPSLDYGLALWFDAYALRRQKYNLLCTQGQWMIQNRRLCGFRTLQPYAERIPVVASDGITINFTSQISLTGPGVQVYYSLYNQSDPCPGEFLCSVNGLCVPACDGIKDCPNGLDERNCVCRAMFQCQEDSTCISLPRVCDRQPDCLNGSDEEQCQEGVPCGTFTFQCEDRSCVKKPNPECDGQADCRDGSDEEHCDCGLQGPSSRIVGGAMSSEGEWPWQASLQIRGRHICGGALIADRWVITAAHCFQEDSMASPRLWTVFLGKMRQNSRWPGEVSFKVSRLFLHPYHEEDSHDYDVALLQLDHPVVYSATVRPVCLPARSHFFEPGQHCWITGWGAQREGGPGSSTLQKVDVQLIPQDLCNEAYRYQVTPRMLCAGYRKGKKDACQGDSGGPLVCKEPSGRWFLAGLVSWGLGCGRPNFFGVYTRVTRVVNWIQQVLT

SEQ ID NO: 6 - protein, 800 aa, Cynomologus
MPVAKAPQVAGGQGDGGDGEEAEPEGMFEACEDSKRKARGYLRLAPLWLTLVVLTSVGVLLWYFLGYKAEVTVSQVYSGSLRVLNRHFSQDLTRRESSAFRSETAKAQKMLKELIASTRLGTYYNSSSVYSFGEGPLTCFFWFILQIPEHRRLMLSPEVVQALLVEELLSTVNSSAAVPYRAEYEVDPEGLVILEASVKDIAALNSTLGCYRYSYVGQGQVLRLKGPDHLASSCLWHLQGPEDLMLKLRLEWTLAECRDRLAMYDVAGPLEKRLITSVYGCSRQEPVVEVLASGAIMAVVWKKGLHSYYDPFMLSVQSVVFQACEVNLTLDDRLDSQGVLSTPYFPSYYSPRTHCSWHLTVPSLDYGLALWFDAYALRRQKYDLPCTQGQWTIQNRRLCGLRILQPYAERIPVVATAGITINFTSQISLTGPGVRVHYGLYNQSDPCPGEFLCSVNGLCVPACDGVKDCPNGLDERNCVCRATFQCQEDSTCISLLKVCDGQPDCLNGSDEERCQEGVPCGTFTFQCEDQSCVKKPNPQCDGRPDCRDGSDEQHCDCGLQGPSSRIVGGAVSSEGEWPWQASLQVRGRHICGGALIADRWVITAAHCFQEDSMASPALWTVFLGKVWQNSRWPGEVSFKVSRLLLHPYHEEDSHDYDVALLQLDHPVVRSAAVRPVCLPARSHFFEPGLHCWITGWGALREGGPTSNALQKVDVQLIPQDLCSEAYRYQVTPRMLCAGYRKGKKDACQGDSGGPLVCKALSGRWFLAGLVSWGLGCGRPNYFGVYTRITGVIGWIQQVVT

SEQ ID NO: 7 - protein, 252 aa, Mus Musculus
MAQLCELRRGRALLALVASLLLSGAQVASRELDVHESCGVSKVVGKCRASIPRWWYNITDGSCQPFVYGGCEGNGNNYQSKEECLDKCAGVTENTTDDMARNRNGADSSVLSVPRKQSAEDLSAEIFNYEEYCVPKAVTGPCRAAFPRWYYDTEKNSCISFIYGGCRGNKNSYLSQEACMQHCSGKQMHPFLTPGLKAVILVGLFLMVLILLLGTSMVCLIRVVRRKQERALRTVWSTADDKEQLVKNTCVL

SEQ ID NO: 8 - protein, 754 aa, Homo sapiens
YKAEVMVSQVYSGSLRVLNRHFSQDLTRRESSAFRSETAKAQKMLKELITSTRLGTYYNSSSVYSFGEGPLTCFFWFILQIPEHRRLMLSPEVVQALLVEELLSTVNSSAAVPYRAEYEVDPEGLVILEASVKDIAALNSTLGCYRYSYVGQGQVLRLKGPDHLASSCLWHLQGPKDLMLKLRLEWTLAECRDRLAMYDVAGPLEKRLITSVYGCSRQEPVVEVLASGAIMAVVWKKGLHSYYDPFVLSVQPVVFQACEVNLTLDNRLDSQGVLSTPYFPSYYSPQTHCSWHLTVPSLDYGLALWFDAYALRRQKYDLPCTQGQWTIQNRRLCGLRILQPYAERIPVVATAGITINFTSQISLTGPGVRVHYGLYNQSDPCPGEFLCSVNGLCVPACDGVKDCPNGLDERNCVCRATFQCKEDSTCISLPKVCDGQPDCLNGSDEEQCQEGVPCGTFTFQCEDRSCVKKPNPQCDGRPDCRDGSDEEHCDCGLQGPSSRIVGGAVSSEGEWPWQASLQVRGRHICGGALIADRWVITAAHCFQEDSMASTVLWTVFLGKVWQNSRWPGEVSFKVSRLLLHPYHEEDSHDYDVALLQLDHPVVRSAAVRPVCLPARSHFFEPGLHCWITGWGALREGGPISNALQKVDVQLIPQDLCSEVYRYQVTPRMLCAGYRKGKKDACQGDSGGPLVCKALSGRWFLAGLVSWGLGCGRPNYFGVYTRITGVISWIQQVVTGKPIPNPLLGLDSTHHHHHH

SEQ ID NO: 9 - protein, 1058 aa, Artificial Sequence
  Human matriptase-2 antigen eGFP/flag tag
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKMLLLFHSKRMPVAEAPQVAGGQGDGGDGEEAEPEGMFKACEDSKRKARGYLRLVPLFVLLALLVLASAGVLLWYFLGYKAEVMVSQVYSGSLRVLNRHFSQDLTRRESSAFRSETAKAQKMLKELITSTRLGTYYNSSSVYSFGEGPLTCFFWFILQIPEHRRLMLSPEVVQALLVEELLSTVNSSAAVPYRAEYEVDPEGLVILEASVKDIAALNSTLGCYRYSYVGQGQVLRLKGPDHLASSCLWHLQGPKDLMLKLRLEWTLAECRDRLAMYDVAGPLEKRLITSVYGCSRQEPVVEVLASGAIMAVVWKKGLHSYYDPFVLSVQPVVFQACEVNLTLDNRLDSQGVLSTPYFPSYYSPQTHCSWHLTVPSLDYGLALWFDAYALRRQKYDLPCTQGQWTIQNRRLCGLRILQPYAERIPVVATAGITINFTSQISLTGPGVRVHYGLYNQSDPCPGEFLCSVNGLCVPACDGVKDCPNGLDERNCVCRATFQCKEDSTCISLPKVCDGQPDCLNGSDEEQCQEGVPCGTFTFQCEDRSCVKKPNPQCDGRPDCRDGSDEEHCDCGLQGPSSRIVGGAVSSEGEWPWQASLQVRGRHICGGALIADRWVITAAHCFQEDSMASTVLWTVFLGKVWQNSRWPGEVSFKVSRLLLHPYHEEDSHDYDVALLQLDHPVVRSAAVRPVCLPARSHFFEPGLHCWITGWGALREGGPISNALQKVDVQLIPQDLCSEVYRYQVTPRMLCAGYRKGKKDACQGDSGGPLVCKALSGRWFLAGLVSWGLGCGRPNYFGVYTRITGVISWIQQVVTDYKDDDDK

SEQ ID NO: 10 - protein, 802 aa, Homo sapiens
MPVAEAPQVAGGQGDGGDGEEAEPEGMFKACEDSKRKARGYLRLVPLFVLLALLVLASAGVLLWYFLGYKAEVMVSQVYSGSLRVLNRHFSQDLTRRESSAFRSETAKAQKMLKELITSTRLGTYYNSSSVYSFGEGPLTCFFWFILQIPEHRRLMLSPEVVQALLVEELLSTVNSSAAVPYRAEYEVDPEGLVILEASVKDIAALNSTLGCYRYSYVGQGQVLRLKGPDHLASSCLWHLQGPKDLMLKLRLEWTLAECRDRLAMYDVAGPLEKRLITSVYGCSRQEPVVEVLASGAIMAVVWKKGLHSYYDPFVLSVQPVVFQACEVNLTLDNRLDSQGVLSTPYFPSYYSPQTHCSWHLTVPSLDYGLALWFDAYALRRQKYDLPCTQGQWTIQNRRLCGLRILQPYAERIPVVATAGITINFTSQISLTGPGVRVHYGLYNQSDPCPGEFLCSVNGLCVPACDGVKDCPNGLDERNCVCRATFQCKEDSTCISLPKVCDGQPDCLNGSDEEQCQEGVPCGTFTFQCEDRSCVKKPNPQCDGRPDCRDGSDEEHCDCGLQGPSSRIVGGAVSSEGEWPWQASLQVRGRHICGGALIADRWVITAAHCFQEDSMASTVLWTVFLGKVWQNSRWPGEVSFKVSRLLLHPYHEEDSHDYDVALLQLDHPVVRSAAVRPVCLPARSHFFEPGLHCWITGWGALREGGPISNALQKVDVQLIPQDLCSEVYRYQVTPRMLCAGYRKGKKDACQGDSGGPLVCKALSGRWFLAGLVSWGLGCGRPNYFGVYTRITGVISWIQQVVT

SEQ ID NO: 11 - protein, 802 aa, Homo sapiens [sequence omitted]

SEQ ID NO: 12 - protein, 802 aa, Homo sapiens [sequence omitted]

SEQ ID NO: 13 - protein, 802 aa, Homo sapiens [sequence omitted]

SEQ ID NO: 14 - protein, 866 aa, Artificial Sequence
  Human matriptase-1 antigen his tag
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGVGGGGSHHHHHH

SEQ ID NO: 15 - protein, 854 aa, Artificial Sequence
  Human matriptase-3 antigen his tag
MDKENSDVSAAPADLKISNISVQVVSAQKKLPVRRPPLPGRRLPLPGRRPPQRPIGKAKPKKQSKKKVPFWNVQNKIILFTVFLFILAVIAWTLLWLYISKTESKDAFYFAGMFRITNIEFLPEYRQKESREFLSVSRTVQQVINLVYTTSAFSKFYEQSVVADVSSNNKGGLLVHFWIVFVMPRAKGHIFCEDCVAAILKDSIQTSIINRTSVGSLQGLAVDMDSVVLNAGLRSDYSSTIGSDKGCSQYFYAEHLSLHYPLEISAASGRLMCHFKLVAIVGYLIRLSIKSIQIEADNCVTDSLTIYDSLLPIRSSILYRICEPTRTLMSFVSTNNLMLVTFKSPHIRRLSGIRAYFEVIPEQKCENTVLVKDITGFEGKISSPYYPSYYPPKCKCTWKFQTSLSTLGIALKFYNYSITKKSMKGCEHGWWEINEHMYCGSYMDHQTIFRVPSPLVHIQLQCSSRLSDKPLLAEYGSYNISQPCPVGSFRCSSGLCVPQAQRCDGVNDCFDESDELFCVSPQPACNTSSFRQHGPLICDGFRDCENGRDEQNCTQSIPCNNRTFKCGNDICFRKQNAKCDGTVDCPDGSDEEGCTCSRSSSALHRIIGGTDTLEGGWPWQVSLHFVGSAYCGASVISREWLLSAAHCFHGNRLSDPTPWTAHLGMYVQGNAKFVSPVRRIVVHEYYNSQTFDYDIALLQLSIAWPETLKQLIQPICIPPTGQRVRSGEKCWVTGWGRRHEADNKGSLVLQQAEVELIDQTLCVSTYGIITSRMLCAGIMSGKRDACKGDSGGPLSCRRKSDGKWILTGIVSWGHGSGRPNFPGVYTRVSNFVPWIHKYVPSLLGGGGSHHHHHH

SEQ ID NO: 16 - protein, 1058 aa, Artificial Sequence
  Mouse matriptase-2 antigen eGFP/flag tag
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKMPRCFQLPCSTRMPTTEVPQAADGQGDAGDGEEAAEPEGKFKPPKNTKRKNRDYVRFTPLLLVLAALVSAGVMLWYFLGYKAEVTVSQVYSGSLRVLNRHFSQDLGRRESIAFRSESAKAQKMLQELVASTRLGTYYNSSSVYSFGEGPLTCFFWFILDIPEYQRLTLSPEVVRELLVDELLSNSSTLASYKTEYEVDPEGLVILEASVNDIVVLNSTLGCYRYSYVNPGQVLPLKGPDQQTTSCLWHLQGPEDLMIKVRLEWTRVDCRDRVAMYDAAGPLEKRLITSVYGCSRQEPVMEVLASGSVMAVVWKKGMHSYYDPFLLSVKSVAFQDCQVNLTLEGRLDTQGFLRTPYYPSYYSPSTHCSWHLTVPSLDYGLALWFDAYALRRQKYNRLCTQGQWMIQNRRLCGFRTLQPYAERIPMVASDGVTINFTSQISLTGPGVQVYYSLYNQSDPCPGEFLCSVNGLCVPACDGIKDCPNGLDERNCVCRAMFQCQEDSTCISLPRVCDRQPDCLNGSDEEQCQEGVPCGTFTFQCEDRSCVKKPNPECDGQSDCRDGSDEQHCDCGLQGLSSRIVGGTVSSEGEWPWQASLQIRGRHICGGALIADRWVITAAHCFQEDSMASPKLWTVFLGKMRQNSRWPGEVSFKVSRLFLHPYHEEDSHDYDVALLQLDHPVVYSATVRPVCLPARSHFFEPGQHCWITGWGAQREGGPVSNTLQKVDVQLVPQDLCSEAYRYQVSPRMLCAGYRKGKKDACQGDSGGPLVCREPSGRWFLAGLVSWGLGCGRPNFFGVYTRVTRVINWIQQVLTDYKDDDDK

SEQ ID NO: 17 - protein, 799 aa, Mus Musculus
MPTTEVPQAADGQGDAGDGEEAAEPEGKFKPPKNTKRKNRDYVRFTPLLLVLAALVSAGVMLWYFLGYKAEVTVSQVYSGSLRVLNRHFSQDLGRRESIAFRSESAKAQKMLQELVASTRLGTYYNSSSVYSFGEGPLTCFFWFILDIPEYQRLTLSPEVVRELLVDELLSNSSTLASYKTEYEVDPEGLVILEASVNDIVVLNSTLGCYRYSYVNPGQVLPLKGPDQQTTSCLWHLQGPEDLMIKVRLEWTRVDCRDRVAMYDAAGPLEKRLITSVYGCSRQEPVMEVLASGSVMAVVWKKGMHSYYDPFLLSVKSVAFQDCQVNLTLEGRLDTQGFLRTPYYPSYYSPSTHCSWHLTVPSLDYGLALWFDAYALRRQKYNRLCTQGQWMIQNRRLCGFRTLQPYAERIPMVASDGVTINFTSQISLTGPGVQVYYSLYNQSDPCPGEFLCSVNGLCVPACDGIKDCPNGLDERNCVCRAMFQCQEDSTCISLPRVCDRQPDCLNGSDEEQCQEGVPCGTFTFQCEDRSCVKKPNPECDGQSDCRDGSDEQHCDCGLQGLSSRIVGGTVSSEGEWPWQASLQIRGRHICGGALIADRWVITAAHCFQEDSMASPKLWTVFLGKMRQNSRWPGEVSFKVSRLFLHPYHEEDSHDYDVALLQLDHPVVYSATVRPVCLPARSHFFEPGQHCWITGWGAQREGGPVSNTLQKVDVQLVPQDLCSEAYRYQVSPRMLCAGYRKGKKDACQGDSGGPLVCREPSGRWFLAGLVSWGLGCGRPNFFGVYTRVTRVINWIQQVLT

SEQ ID NO: 18 - protein, 799 aa, Rattus norvegicus
MPTAEVPQAAGGQGDGGDGEEAAEPEGVFKAPRNAKRKDRDYVRFTPLLLVLAALASAGVMLWYFLGYKAEVTISQVYSGSLRVLNRHFSQDLARRESIAFRTETAKAQKMFQELVASTRLGTYYNSSSIYAFGEGPLICFFWFILDIPEYQRLTLSPEVVRELLVGELLSNSSALASYRTEYEVDPEGLVILEASVNDIVVLNSTLGCYRYSYVNPGQVLRLRGPDQQTTSCLWHLQGPEDLMLKVQLEWTRVDCRDRVAMYDAAGPLEKRLITSVYGCSRQEPVMEVLASGSVMAVVWKKGLHSFYDPFLLSVKSVAFQDCQVNLTLEGRLDPQGFLRTPYYPSYYSPSTHCSWHLTVPSLDYGLALWFDAYALRRQKYNLLCTQGQWMIQNRRLCGFRTLQPYAERIPVVASDGITINFTSQISLTGPGVQVYYSLYNQSDPCPGEFLCSVNGLCVPACDGIKDCPNGLDERNCVCRAMFQCQEDSTCISLPRVCDRQPDCLNGSDEEQCQEGVPCGTFTFQCEDRSCVKKPNPECDGQADCRDGSDEEHCDCGLQGPSSRIVGGAMSSEGEWPWQASLQIRGRHICGGALIADRWVITAAHCFQEDSMASPRLWTVFLGKMRQNSRWPGEVSFKVSRLFLHPYHEEDSHDYDVALLQLDHPVVYSATVRPVCLPARSHFFEPGQHCWITGWGAQREGGPGSSTLQKVDVQLIPQDLCNEAYRYQVTPRMLCAGYRKGKKDACQGDSGGPLVCKEPSGRWFLAGLVSWGLGCGRPNFFGVYTRVTRVVNWIQQVLT

SEQ ID NO: 19 - protein, 800 aa, Cynomologus; identical to SEQ ID NO: 6

SEQ ID NO: 20 - protein, 756 aa, Artificial Sequence
  Human matriptase-2 ECD protein his tag
YKAEVMVSQVYSGSLRVLNRHFSQDLTRRESSAFRSETAKAQKMLKELITSTRLGTYYNSSSVYSFGEGPLTCFFWFILQIPEHRRLMLSPEVVQALLVEELLSTVNSSAAVPYRAEYEVDPEGLVILEASVKDIAALNSTLGCYRYSYVGQGQVLRLKGPDHLASSCLWHLQGPKDLMLKLRLEWTLAECRDRLAMYDVAGPLEKRLITSVYGCSRQEPVVEVLASGAIMAVVWKKGLHSYYDPFVLSVQPVVFQACEVNLTLDNRLDSQGVLSTPYFPSYYSPQTHCSWHLTVPSLDYGLALWFDAYALRRQKYDLPCTQGQWTIQNRRLCGLRILQPYAERIPVVATAGITINFTSQISLTGPGVRVHYGLYNQSDPCPGEFLCSVNGLCVPACDGVKDCPNGLDERNCVCRATFQCKEDSTCISLPKVCDGQPDCLNGSDEEQCQEGVPCGTFTFQCEDRSCVKKPNPQCDGRPDCRDGSDEEHCDCGLQGPSSRIVGGAVSSEGEWPWQASLQVRGRHICGGALIADRWVITAAHCFQEDSMASTVLWTVFLGKVWQNSRWPGEVSFKVSRLLLHPYHEEDSHDYDVALLQLDHPVVRSAAVRPVCLPARSHFFEPGLHCWITGWGALREGGPISNALQKVDVQLIPQDLCSEVYRYQVTPRMLCAGYRKGKKDACQGDSGGPLVCKALSGRWFLAGLVSWGLGCGRPNYFGVYTRITGVISWIQQVVTGGGGSGGGGSHHHHHHGSHHHH

SEQ ID NO: 21 - protein, 521 aa, Artificial Sequence
  Human matriptase-2 mask ECD protein his tag
YKAEVMVSQVYSGSLRVLNRHFSQDLTRRESSAFRSETAKAQKMLKELITSTRLGTYYNSSSVYSFGEGPLTCFFWFILQIPEHRRLMLSPEVVQALLVEELLSTVNSSAAVPYRAEYEVDPEGLVILEASVKDIAALNSTLGCYRYSYVGQGQVLRLKGPDHLASSCLWHLQGPKDLMLKLRLEWTLAECRDRLAMYDVAGPLEKRLITSVYGCSRQEPVVEVLASGAIMAVVWKKGLHSYYDPFVLSVQPVVFQACEVNLTLDNRLDSQGVLSTPYFPSYYSPQTHCSWHLTVPSLDYGLALWFDAYALRRQKYDLPCTQGQWTIQNRRLCGLRILQPYAERIPVVATAGITINFTSQISLTGPGVRVHYGLYNQSDPCPGEFLCSVNGLCVPACDGVKDCPNGLDERNCVCRATFQCKEDSTCISLPKVCDGQPDCLNGSDEEQCQEGVPCGTFTFQCEDRSCVKKPNPQCDGRPDCRDGSDEEHCDSGLQGPSSRGGGGSGGGGSHHHHHHGSHHHH

SEQ ID NO: 22 - protein, 795 aa, Artificial Sequence
  Human matriptase-1 ECD protein his tag
WHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGVGGGGSGGGGSHHHHHH

SEQ ID NO: 23 - protein, 754 aa, Artificial Sequence
  Mouse matriptase-2 ECD protein his tag
YKAEVTVSQVYSGSLRVLNRHFSQDLGRRESIAFRSESAKAQKMLQELVASTRLGTYYNSSSVYSFGEGPLTCFFWFILDIPEYQRLTLSPEVVRELLVDELLSNSSTLASYKTEYEVDPEGLVILEASVNDIVVLNSTLGCYRYSYVNPGQVLPLKGPDQQTTSCLWHLQGPEDLMIKVRLEWTRVDCRDRVAMYDAAGPLEKRLITSVYGCSRQEPVMEVLASGSVMAVVWKKGMHSYYDPFLLSVKSVAFQDCQVNLTLEGRLDTQGFLRTPYYPSYYSPSTHCSWHLTVPSLDYGLALWFDAYALRRQKYNRLCTQGQWMIQNRRLCGFRTLQPYAERIPMVASDGVTINFTSQISLTGPGVQVYYSLYNQSDPCPGEFLCSVNGLCVPACDGIKDCPNGLDERNCVCRAMFQCQEDSTCISLPRVCDRQPDCLNGSDEEQCQEGVPCGTFTFQCEDRSCVKKPNPECDGQSDCRDGSDEQHCDCGLQGLSSRIVGGTVSSEGEWPWQASLQIRGRHICGGALIADRWVITAAHCFQEDSMASPKLWTVFLGKMRQNSRWPGEVSFKVSRLFLHPYHEEDSHDYDVALLQLDHPVVYSATVRPVCLPARSHFFEPGQHCWITGWGAQREGGPVSNTLQKVDVQLVPQDLCSEAYRYQVSPRMLCAGYRKGKKDACQGDSGGPLVCREPSGRWFLAGLVSWGLGCGRPNFFGVYTRVTRVINWIQQVLTGGGGSGGGGSHHHHHHGSHHHH

SEQ ID NO: 24 - protein, 170 aa, Mus Musculus
ASRELDVHESCGVSKVVGKCRASIPRWWYNITDGSCQPFVYGGCEGNGNNYQSKEECLDKCAGVTENTTDDMARNRNGADSSVLSVPRKQSAEDLSAEIFNYEEYCVPKAVTGPCRAAFPRWYYDTEKNSCISFIYGGCRGNKNSYLSQEACMQHCSGKQMHPFLTPGLK

SEQ ID NO: 25 - protein, 750 aa, Artificial Sequence
  Cyno matriptase-2 ECD protein His tag
VSQVYSGSLRVLNRHFSQDLTRRESSAFRSETAKAQKMLKELIASTRLGTYYNSSSVYSFGEGPLTCFFWFILQIPEHRRLMLSPEVVQALLVEELLSTVNSSAAVPYRAEYEVDPEGLVILEASVKDIAALNSTLGCYRYSYVGQGQVLRLKGPDHLASSCLWHLQGPEDLMLKLRLEWTLAECRDRLAMYDVAGPLEKRLITSVYGCSRQEPVVEVLASGAIMAVVWKKGLHSYYDPFMLSVQSVVFQACEVNLTLDDRLDSQGVLSTPYFPSYYSPRTHCSWHLTVPSLDYGLALWFDAYALRRQKYDLPCTQGQWTIQNRRLCGLRILQPYAERIPVVATAGITINFTSQISLTGPGVRVHYGLYNQSDPCPGEFLCSVNGLCVPACDGVKDCPNGLDERNCVCRATFQCQEDSTCISLLKVCDGQPDCLNGSDEERCQEGVPCGTFTFQCEDQSCVKKPNPQCDGRPDCRDGSDEQHCDCGLQGPSSRIVGGAVSSEGEWPWQASLQVRGRHICGGALIADRWVITAAHCFQEDSMASPALWTVFLGKVWQNSRWPGEVSFKVSRLLLHPYHEEDSHDYDVALLQLDHPVVRSAAVRPVCLPARSHFFEPGLHCWITGWGALREGGPTSNALQKVDVQLIPQDLCSEAYRYQVTPRMLCAGYRKGKKDACQGDSGGPLVCKALSGRWFLAGLVSWGLGCGRPNYFGVYTRITGVIGWIQQVVTGGGGSGGGGSHHHHHHGSHHHH

SEQ ID NO: 26 - protein, 754 aa, Artificial Sequence
  Rat matriptase-2 ECD protein his tag
YKAEVTISQVYSGSLRVLNRHFSQDLARRESIAFRTETAKAQKMFQELVASTRLGTYYNSSSIYAFGEGPLICFFWFILDIPEYQRLTLSPEVVRELLVGELLSNSSALASYRTEYEVDPEGLVILEASVNDIVVLNSTLGCYRYSYVNPGQVLRLRGPDQQTTSCLWHLQGPEDLMLKVQLEWTRVDCRDRVAMYDAAGPLEKRLITSVYGCSRQEPVMEVLASGSVMAVVWKKGLHSFYDPFLLSVKSVAFQDCQVNLTLEGRLDPQGFLRTPYYPSYYSPSTHCSWHLTVPSLDYGLALWFDAYALRRQKYNLLCTQGQWMIQNRRLCGFRTLQPYAERIPVVASDGITINFTSQISLTGPGVQVYYSLYNQSDPCPGEFLCSVNGLCVPACDGIKDCPNGLDERNCVCRAMFQCQEDSTCISLPRVCDRQPDCLNGSDEEQCQEGVPCGTFTFQCEDRSCVKKPNPECDGQADCRDGSDEEHCDCGLQGPSSRIVGGAMSSEGEWPWQASLQIRGRHICGGALIADRWVITAAHCFQEDSMASPRLWTVFLGKMRQNSRWPGEVSFKVSRLFLHPYHEEDSHDYDVALLQLDHPVVYSATVRPVCLPARSHFFEPGQHCWITGWGAQREGGPGSSTLQKVDVQLIPQDLCNEAYRYQVTPRMLCAGYRKGKKDACQGDSGGPLVCKEPSGRWFLAGLVSWGLGCGRPNFFGVYTRVTRVVNWIQQVLTGGGGSGGGGSHHHHHHGSHHHH

SEQ ID NO: 27 - protein, 8 aa, Artificial Sequence
  Flag tag
DYKDDDDK

SEQ ID NO: 28 - protein, 100 aa, Homo sapiens
MKMSRLCLSVALLVLLGTLAASTPGCDTSNQAKAQRPDFCLEPPYTGPCKARIIRYFYNAKAGLCQTFVYGGCRAKRNNFKSAEDCMRTCGGAIGPWENL

SEQ ID NO: 29 - protein, 8 aa, Homo sapiens
GYTLSEFS

SEQ ID NO: 30 - protein, 8 aa, Homo sapiens
FDPEKGKT

SEQ ID NO: 31 - protein, 14 aa, Homo sapiens
VTEGHFYGSGVFDF

SEQ ID NO: 32 - protein, 5 aa, Homo sapiens
EFSIH

SEQ ID NO: 33 - protein, 17 aa, Homo sapiens
GFDPEKGKTIYAQKFQG

SEQ ID NO: 34 - protein, 12 aa, Homo sapiens
EGHFYGSGVFDF

SEQ ID NO: 35 - protein, 121 aa, Homo sapiens
QVQLVQSGAEVKKPGASVKVSCKVSGYTLSEFSIHWVRQAPGKGLEWMGGFDPEKGKTIYAQKFQGRVTMTEDTSTDTAYMDLSSLRSEDTAVYYCVTEGHFYGSGVFDFWGQGTLVTVSS

SEQ ID NO: 36 - DNA, 363 bp, Homo sapiens
caggtccagctggtacaatctggggctgaggtgaagaagcctggggcctcagtgaaggtctcctgcaaagtctccggatacaccctcagtgaattctccatacactgggtgcgacaggctcctggaaaagggcttgagtggatgggaggctttgatcctgaaaaaggtaaaacaatctacgcacagaagttccagggcagagtcaccatgaccgaggacacatcaacagacacagcctacatggacctgagcagcctgagatctgaggacacggccgtgtattactgtgtaacagagggacatttctatggttcgggggtctttgacttctggggccagggaaccctggtcaccgtctcctca

SEQ ID NO: 37 - protein, 448 aa, Homo sapiens
QVQLVQSGAEVKKPGASVKVSCKVSGYTLSEFSIHWVRQAPGKGLEWMGGFDPEKGKTIYAQKFQGRVTMTEDTSTDTAYMDLSSLRSEDTAVYYCVTEGHFYGSGVFDFWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 38 - DNA, 1344 bp, Homo sapiens
caggtccagctggtacaatctggggctgaggtgaagaagcctggggcctcagtgaaggtctcctgcaaagtctccggatacaccctcagtgaattctccatacactgggtgcgacaggctcctggaaaagggcttgagtggatgggaggctttgatcctgaaaaaggtaaaacaatctacgcacagaagttccagggcagagtcaccatgaccgaggacacatcaacagacacagcctacatggacctgagcagcctgagatctgaggacacggccgtgtattactgtgtaacagagggacatttctatggttcgggggtctttgacttctggggccagggaaccctggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 39 - protein, 6 aa, Homo sapiens
QGLRFD

SEQ ID NO: 40 - protein, 3 aa, Homo sapiens
AAS

SEQ ID NO: 41 - protein, 9 aa, Homo sapiens
LQHNNYPWT

SEQ ID NO: 42 - protein, 11 aa, Homo sapiens
RPSQGLRFDFG

SEQ ID NO: 43 - protein, 7 aa, Homo sapiens
AASILQS

SEQ ID NO: 44 - protein, 107 aa, Homo sapiens
DIQMTQSPSSLSASVGDRVTITCRPSQGLRFDFGWYQQRPGKAPRRLIYAASILQSGVPSRFSGSGSGTEFTLTISSLQPEDFATYYCLQHNNYPWTFGQGTKVEIK

SEQ ID NO: 45 - DNA, 321 bp, Homo sapiens
gacatccagatgacccagtctccatcatccctgtctgcatctgttggagacagagtcaccatcacttgccggccaagtcagggccttagatttgatttcggctggtatcaacagagaccaggtaaagcccctaggcgcctgatctatgcggcatccattttgcaaagtggggtcccatcaagattcagcggcagtggatctgggacagaattcactctcacaatcagcagcctgcagcctgaagattttgcaacttattactgtctacaacataacaattatccgtggacgttcggccaagggaccaaggtggaaatcaaa

SEQ ID NO: 46 - protein, 214 aa, Homo sapiens
DIQMTQSPSSLSASVGDRVTITCRPSQGLRFDFGWYQQRPGKAPRRLIYAASILQSGVPSRFSGSGSGTEFTLTISSLQPEDFATYYCLQHNNYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 47 - DNA, 642 bp, Homo sapiens
gacatccagatgacccagtctccatcatccctgtctgcatctgttggagacagagtcaccatcacttgccggccaagtcagggccttagatttgatttcggctggtatcaacagagaccaggtaaagcccctaggcgcctgatctatgcggcatccattttgcaaagtggggtcccatcaagattcagcggcagtggatctgggacagaattcactctcacaatcagcagcctgcagcctgaagattttgcaacttattactgtctacaacataacaattatccgtggacgttcggccaagggaccaaggtggaaatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 48 - protein, 8 aa, Homo sapiens
GFTFGDFG

SEQ ID NO: 49 - protein, 10 aa, Homo sapiens
IRSKPYGGTT

SEQ ID NO: 50 - protein, 14 aa, Homo sapiens
SRNEILTGYYIFDY

SEQ ID NO: 51 - protein, 5 aa, Homo sapiens
DFGMS

SEQ ID NO: 52 - protein, 19 aa, Homo sapiens
FIRSKPYGGTTDYAPSVRG

SEQ ID NO: 53 - protein, 12 aa, Homo sapiens
NEILTGYYIFDY

SEQ ID NO: 54 - protein, 123 aa, Homo sapiens
EVQLVESGGGLVKPGRSLRLSCTGSGFTFGDFGMSWFRQAPGKGLEWVCFIRSKPYGGTTDYAPSVRGRFSISRDDSKGIVYLQMNSLRTEDTAVYYCSRNEILTGYYIFDYWGQGTLVTVSS

SEQ ID NO: 55 - DNA, 369 bp, Homo sapiens
gaggttcagttggtggaatctgggggaggcttggtaaagccagggcggtccctgagactctcctgtacaggttctggattcacctttggtgattttggtatgagctggttccgtcaggctccagggaaggggctggagtgggtatgtttcattagaagcaaaccctatggtggaacaacagattacgccccgtctgtgagaggcagattcagcatctcaagagatgattccaaaggcatcgtctatctacagatgaacagcctgagaaccgaggacacagccgtctattattgtagtagaaacgaaattttgactggttattatatctttgactactggggccagggaaccctggtcaccgtctcctca

SEQ ID NO: 56 - protein, 450 aa, Homo sapiens
EVQLVESGGGLVKPGRSLRLSCTGSGFTFGDFGMSWFRQAPGKGLEWVCFIRSKPYGGTTDYAPSVRGRFSISRDDSKGIVYLQMNSLRTEDTAVYYCSRNEILTGYYIFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 57 - DNA, 1350 bp, Homo sapiens
gaggttcagttggtggaatctgggggaggcttggtaaagccagggcggtccctgagactctcctgtacaggttctggattcacctttggtgattttggtatgagctggttccgtcaggctccagggaaggggctggagtgggtatgtttcattagaagcaaaccctatggtggaacaacagattacgccccgtctgtgagaggcagattcagcatctcaagagatgattccaaaggcatcgtctatctacagatgaacagcctgagaaccgaggacacagccgtctattattgtagtagaaacgaaattttgactggttattatatctttgactactggggccagggaaccctggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 58 - protein, 6 aa, Homo sapiens
HDITNY

SEQ ID NO: 59 - protein, 3 aa, Homo sapiens
DAS

SEQ ID NO: 60 - protein, 9 aa, Homo sapiens
QQYYNLPLT

SEQ ID NO: 61 - protein, 11 aa, Homo sapiens
QASHDITNYLI

SEQ ID NO: 62 - protein, 7 aa, Homo sapiens
DASILET

SEQ ID NO: 63 - protein, 107 aa, Homo sapiens
DIQMTQSPSSLSASLGDRVTITCQASHDITNYLIWYQQKPGKAPRLLIFDASILETGVPSRFSGSGSGTDFTFTISSLQPEDFATYYCQQYYNLPLTFGGGTKVDIK

SEQ ID NO: 64 - DNA, 321 bp, Homo sapiens
gacatccagatgacccagtctccatcctccctgtctgcttctttaggagacagagtcaccatcacttgccaggcgagtcatgacattaccaactatttgatttggtatcagcagaaaccggggaaagcccctagactccttatcttcgatgcatccattttggaaacaggggtcccatcaaggttcagtggaagtggatctgggacagattttactttcaccatcagcagcctgcagcctgaagattttgcaacatattactgtcaacaatattataatctcccgctcactttcggcggaggaaccaaggtggacatcaaa

SEQ ID NO: 65 - protein, 214 aa, Homo sapiens
DIQMTQSPSSLSASLGDRVTITCQASHDITNYLIWYQQKPGKAPRLLIFDASILETGVPSRFSGSGSGTDFTFTISSLQPEDFATYYCQQYYNLPLTFGGGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 66 - DNA, 642 bp, Homo sapiens
gacatccagatgacccagtctccatcctccctgtctgcttctttaggagacagagtcaccatcacttgccaggcgagtcatgacattaccaactatttgatttggtatcagcagaaaccggggaaagcccctagactccttatcttcgatgcatccattttggaaacaggggtcccatcaaggttcagtggaagtggatctgggacagattttactttcaccatcagcagcctgcagcctgaagattttgcaacatattactgtcaacaatattataatctcccgctcactttcggcggaggaaccaaggtggacatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 67 - protein, 123 aa, Homo sapiens
EVQLVESGGGLVKPGRSLRLSCTGSGFTFGDFGMSWFRQAPGKGLEWVGFIRSKPYGGTTDYAPSVRGRFSISRDDSKGIVYLQMNSLRTEDTAVYYCSRNEILTGYYIFDYWGQGTLVTVSS

SEQ ID NO: 68 - DNA, 369 bp, Homo sapiens
gaggttcagttggtggaatctgggggaggcttggtaaagccagggcggtccctgagactctcctgtacaggttctggattcacctttggtgattttggtatgagctggttccgtcaggctccagggaaggggctggagtgggtaggtttcattagaagcaaaccctatggtggaacaacagattacgccccgtctgtgagaggcagattcagcatctcaagagatgattccaaaggcatcgtctatctacagatgaacagcctgagaaccgaggacacagccgtctattattgtagtagaaacgaaattttgactggttattatatctttgactactggggccagggaaccctggtcaccgtctcctca

SEQ ID NO: 69 - protein, 450 aa, Homo sapiens
EVQLVESGGGLVKPGRSLRLSCTGSGFTFGDFGMSWFRQAPGKGLEWVGFIRSKPYGGTTDYAPSVRGRFSISRDDSKGIVYLQMNSLRTEDTAVYYCSRNEILTGYYIFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 70 - DNA, 1350 bp, Homo sapiens
gaggttcagttggtggaatctgggggaggcttggtaaagccagggcggtccctgagactctcctgtacaggttctggattcacctttggtgattttggtatgagctggttccgtcaggctccagggaaggggctggagtgggtaggtttcattagaagcaaaccctatggtggaacaacagattacgccccgtctgtgagaggcagattcagcatctcaagagatgattccaaaggcatcgtctatctacagatgaacagcctgagaaccgaggacacagccgtctattattgtagtagaaacgaaattttgactggttattatatctttgactactggggccagggaaccctggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 71 - DNA, 321 bp, Homo sapiens; identical to SEQ ID NO: 64

SEQ ID NO: 72 - DNA, 642 bp, Homo sapiens; identical to SEQ ID NO: 66

SEQ ID NO: 73 - protein, 19 aa, Homo sapiens
FIRSKPYGGTTDYAPSVKD

SEQ ID NO: 74 - protein, 123 aa, Homo sapiens
EVQLVESGGGLVKPGRSLRLSCTGSGFTFGDFGMSWFRQAPGKGLEWVCFIRSKPYGGTTDYAPSVKDRFTISRDDSKDIVYLQMNSLRTEDTAVYYCSRNEILTGYYIFDYWGQGTLVTVSS

SEQ ID NO: 75 - DNA, 369 bp, Homo sapiens
gaggtgcagttggtggaatctgggggaggcttggtaaagccagggcggtccctgagactctcctgtacaggttctggattcacctttggtgattttggtatgagctggttccgtcaggcgccagggaaggggctggagtgggtatgtttcattagaagcaaaccctatggtggaacaacagattacgccccgtctgtgaaagacagattcaccatctcaagagatgattccaaagacatcgtctatctgcaaatgaacagcctgagaaccgaggacacagccgtctattattgtagtagaaacgaaattttgactggttattatatctttgactactggggccagggaaccctggtcaccgtctcctca

SEQ ID NO: 76 - protein, 450 aa, Homo sapiens
EVQLVESGGGLVKPGRSLRLSCTGSGFTFGDFGMSWFRQAPGKGLEWVCFIRSKPYGGTTDYAPSVKDRFTISRDDSKDIVYLQMNSLRTEDTAVYYCSRNEILTGYYIFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 77 - DNA, 1350 bp, Homo sapiens
gaggtgcagttggtggaatctgggggaggcttggtaaagccagggcggtccctgagactctcctgtacaggttctggattcacctttggtgattttggtatgagctggttccgtcaggcgccagggaaggggctggagtgggtatgtttcattagaagcaaaccctatggtggaacaacagattacgccccgtctgtgaaagacagattcaccatctcaagagatgattccaaagacatcgtctatctgcaaatgaacagcctgagaaccgaggacacagccgtctattattgtagtagaaacgaaattttgactggttattatatctttgactactggggccagggaaccctggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 78 - DNA, 321 bp, Homo sapiens
gacatccagatgacccagtctccatcctccctgtctgcttctttaggagacagagtcaccatcacttgccaggcgagtcatgacattaccaactatttgatttggtatcagcagaaaccggggaaagcccctagactccttatcttcgatgcatccattttggaaacaggggtcccatcaaggttcagtggaagtggatctgggacagattttactttcaccatcagcagcctgcagcctgaagattttgcaacatattactgtcaacaatattataatttgccgctcactttcggcggagggaccaaggtggacatcaaa

SEQ ID NO: 79 - DNA, 642 bp, Homo sapiens
gacatccagatgacccagtctccatcctccctgtctgcttctttaggagacagagtcaccatcacttgccaggcgagtcatgacattaccaactatttgatttggtatcagcagaaaccggggaaagcccctagactccttatcttcgatgcatccattttggaaacaggggtcccatcaaggttcagtggaagtggatctgggacagattttactttcaccatcagcagcctgcagcctgaagattttgcaacatattactgtcaacaatattataatttgccgctcactttcggcggagggaccaaggtggacatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 80 - protein, 14 aa, Homo sapiens
ARNEILTGYYIFDY

SEQ ID NO: 81 - protein, 5 aa, Homo sapiens
DFGLS

SEQ ID NO: 82 - protein, 19 aa, Homo sapiens
FIRSKPYGGTTDYAASVKG

SEQ ID NO: 83 - protein, 123 aa, Homo sapiens
EVHLVESGGGLIKPGRSLRLSCTGSGFTFGDFGLSWFRQAPGKGLEWISFIRSKPYGGTTDYAASVKGRFTISRDDSKSVAYLQMNSLKTEDSAVYYCARNEILTGYYIFDYWGQGILVTVSS

SEQ ID NO: 84 - DNA, 369 bp, Homo sapiens
gaggtacacctggtggagtctgggggaggcttgataaagccagggcggtccctgagactctcctgtacaggttctggattcacctttggtgattttggtctgagttggttccgccaggctccagggaaggggctggaatggatatctttcatcagaagcaaaccttatggtgggacaacagattacgccgcctctgtgaaaggcagattcaccatttcaagagatgattccaaaagcgtcgcctatctgcaaatgaacagcctgaaaaccgaggactcagccgtgtattactgtgccagaaacgagattttgactggttactatatctttgactactggggccagggaatcctggtcaccgtctcctca

SEQ ID NO: 85 - protein, 450 aa, Homo sapiens
EVHLVESGGGLIKPGRSLRLSCTGSGFTFGDFGLSWFRQAPGKGLEWISFIRSKPYGGTTDYAASVKGRFTISRDDSKSVAYLQMNSLKTEDSAVYYCARNEILTGYYIFDYWGQGILVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 86 - DNA, 1350 bp, Homo sapiens
gaggtacacctggtggagtctgggggaggcttgataaagccagggcggtccctgagactctcctgtacaggttctggattcacctttggtgattttggtctgagttggttccgccaggctccagggaaggggctggaatggatatctttcatcagaagcaaaccttatggtgggacaacagattacgccgcctctgtgaaaggcagattcaccatttcaagagatgattccaaaagcgtcgcctatctgcaaatgaacagcctgaaaaccgaggactcagccgtgtattactgtgccagaaacgagattttgactggttactatatctttgactactggggccagggaatcctggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 87 - protein, 6 aa, Homo sapiens
QDISNY

SEQ ID NO: 88 - protein, 9 aa, Homo sapiens
QQYDNLPLT

SEQ ID NO: 89 - protein, 11 aa, Homo sapiens
QASQDISNYLS

SEQ ID NO: 90 - protein, 107 aa, Homo sapiens
DIQMTQSPSSLSASLGDRLTITCQASQDISNYLSWYQLQPGKAPKLLIFDASILETGVPSRFSGSGSGTDFSFTVSSLQPEDIATYYCQQYDNLPLTFGGGTKVDLK

SEQ ID NO: 91 - DNA, 321 bp, Homo sapiens
gacatccagatgacccagtctccatcctccctgtctgcttctttaggagacagactcaccatcacttgccaggcgagtcaggacattagcaactatttaagttggtatcaactgcaaccagggaaagcccctaagctcctgatcttcgatgcatccattttggaaacaggggtcccatcaaggttcagtggaagtggatctgggacagatttttctttcaccgtcagtagcctgcagcctgaagatattgcaacatattactgtcaacagtatgataatctcccgctcactttcggcggggggaccaaggtggatctcaaa

SEQ ID NO: 92 - protein, 214 aa, Homo sapiens
DIQMTQSPSSLSASLGDRLTITCQASQDISNYLSWYQLQPGKAPKLLIFDASILETGVPSRFSGSGSGTDFSFTVSSLQPEDIATYYCQQYDNLPLTFGGGTKVDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 93 - DNA, 642 bp, Homo sapiens
gacatccagatgacccagtctccatcctccctgtctgcttctttaggagacagactcaccatcacttgccaggcgagtcaggacattagcaactatttaagttggtatcaactgcaaccagggaaagcccctaagctcctgatcttcgatgcatccattttggaaacaggggtcccatcaaggttcagtggaagtggatctgggacagatttttctttcaccgtcagtagcctgcagcctgaagatattgcaacatattactgtcaacagtatgataatctcccgctcactttcggcggggggaccaaggtggatctcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 94 - protein, 123 aa, Homo sapiens
EVQLVESGGGLIKPGRSLRLSCTGSGFTFGDFGLSWFRQAPGKGLEWISFIRSKPYGGTTDYAASVKGRFTISRDDSKNVAYLQMNSLKTEDTAVYYCARNEILTGYYIFDYWGQGTLVTVSS

SEQ ID NO: 95 - DNA, 369 bp, Homo sapiens
gaggtgcagctggtggagtctgggggaggattgataaagccagggcggtccctgagactctcctgtacaggttctggattcacctttggtgattttggtctgagctggttccgccaggctccagggaagggactggaatggatatctttcattagaagtaaaccttatggtgggacaacagattacgccgcctctgtgaaaggcagattcaccatatcaagagatgattccaaaaacgtcgcctatctacaaatgaacagcctgaagaccgaggacacagccgtgtattactgtgctagaaacgagattttgactggttattatatctttgactactggggccagggaaccctggtcaccgtctcctca

SEQ ID NO: 96 - protein, 450 aa, Homo sapiens
EVQLVESGGGLIKPGRSLRLSCTGSGFTFGDFGLSWFRQAPGKGLEWISFIRSKPYGGTTDYAASVKGRFTISRDDSKNVAYLQMNSLKTEDTAVYYCARNEILTGYYIFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 97 - DNA, 1350 bp, Homo sapiens
gaggtgcagctggtggagtctgggggaggattgataaagccagggcggtccctgagactctcctgtacaggttctggattcacctttggtgattttggtctgagctggttccgccaggctccagggaagggactggaatggatatctttcattagaagtaaaccttatggtgggacaacagattacgccgcctctgtgaaaggcagattcaccatatcaagagatgattccaaaaacgtcgcctatctacaaatgaacagcctgaagaccgaggacacagccgtgtattactgtgctagaaacgagattttgactggttattatatctttgactactggggccagggaaccctggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 98 - protein, 6 aa, Homo sapiens
QDINNY

SEQ ID NO: 99 - protein, 11 aa, Homo sapiens
QASQDINNYLN

SEQ ID NO: 100 - protein, 107 aa, Homo sapiens
DIQMTQSPSSLSASLGDRVTITCQASQDINNYLNWYQVQPGKAPKLLIFDASILETGVPSRFSGSGSGTDFSFTISSLQPEDIATYYCQQYDNLPLTFGGGTKVDFK

SEQ ID NO: 101 - DNA, 321 bp, Homo sapiens
gacatccagatgacccagtctccatcctccctgtctgcttctttaggagacagagtcaccatcacttgccaggcgagtcaggacattaacaactatttaaattggtatcaagtgcaaccagggaaagcccctaagctcctgatcttcgatgcatccattttggaaacaggggtcccatcacggttcagtggaagtggatctgggacagatttttctttcaccatcagtagcctgcagcctgaagatattgcaacatattactgtcaacaatatgataatctcccgctcactttcggcggagggaccaaggtggatttcaaa

SEQ ID NO: 102 - protein, 214 aa, Homo sapiens
DIQMTQSPSSLSASLGDRVTITCQASQDINNYLNWYQVQPGKAPKLLIFDASILETGVPSRFSGSGSGTDFSFTISSLQPEDIATYYCQQYDNLPLTFGGGTKVDFKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 103 - DNA, 642 bp, Homo sapiens
gacatccagatgacccagtctccatcctccctgtctgcttctttaggagacagagtcaccatcacttgccaggcgagtcaggacattaacaactatttaaattggtatcaagtgcaaccagggaaagcccctaagctcctgatcttcgatgcatccattttggaaacaggggtcccatcacggttcagtggaagtggatctgggacagatttttctttcaccatcagtagcctgcagcctgaagatattgcaacatattactgtcaacaatatgataatctcccgctcactttcggcggagggaccaaggtggatttcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 104 - protein, 14 aa, Homo sapiens
SRNDILTGYYIFDY

SEQ ID NO: 105 - protein, 19 aa, Homo sapiens
FIRSKPYGGTTDYAPSVKG

SEQ ID NO: 106 - protein, 12 aa, Homo sapiens
NDILTGYYIFDY

SEQ ID NO: 107 - protein, 123 aa, Homo sapiens
EVQLVESGGGLVKPGRSLRLSCTGSGFTFGDFGMSWFRQAPGKGLEWVCFIRSKPYGGTTDYAPSVKGRFTISRDDSISIAYLQMNSLTTEDTAVYYCSRNDILTGYYIFDYWGQGTQVTVSS

SEQ ID NO: 108 - DNA, 369 bp, Homo sapiens
gaggtgcagttggtggaatctgggggaggcttggtaaaaccagggcggtccctgagactctcctgtacaggttctggattcacctttggtgattttggtatgagttggttccgccaggctccagggaaggggctggagtgggtatgtttcattagaagcaaaccttatggtggaacaacagattatgccccgtctgtgaaaggcagattcaccatctcaagagatgattccataagcatcgcctatctgcaaatgaatagcctgacaaccgaggacacagccgtatattattgtagtcgaaacgatattttgaccggttattatatctttgactactggggccagggaacccaggtcaccgtctcctca

SEQ ID NO: 109 - protein, 450 aa, Homo sapiens
EVQLVESGGGLVKPGRSLRLSCTGSGFTFGDFGMSWFRQAPGKGLEWVCFIRSKPYGGTTDYAPSVKGRFTISRDDSISIAYLQMNSLTTEDTAVYYCSRNDILTGYYIFDYWGQGTQVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 110 - DNA, 1350 bp, Homo sapiens
gaggtgcagttggtggaatctgggggaggcttggtaaaaccagggcggtccctgagactctcctgtacaggttctggattcacctttggtgattttggtatgagttggttccgccaggctccagggaaggggctggagtgggtatgtttcattagaagcaaaccttatggtggaacaacagattatgccccgtctgtgaaaggcagattcaccatctcaagagatgattccataagcatcgcctatctgcaaatgaatagcctgacaaccgaggacacagccgtatattattgtagtcgaaacgatattttgaccggttattatatctttgactactggggccagggaacccaggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 111 - protein, 6 aa, Homo sapiens
QDITNY

SEQ ID NO: 112 - protein, 11 aa, Homo sapiens
QASQDITNYLI

SEQ ID NO: 113 - protein, 7 aa, Homo sapiens
DASNLET

SEQ ID NO: 114 - protein, 107 aa, Homo sapiens
DIQMTQSPSSLSASLGDSITITCQASQDITNYLIWYQHKPGKAPKLLIFDASNLETGVPSRFSGSGSGTDFTFTISSLQPEDYATYYCQQYYNLPLTFGGGTKVDIK

SEQ ID NO: 115 - DNA, 321 bp, Homo sapiens
gacatccagatgacccagtctccatcctccctgtctgcttctttaggagacagcatcaccatcacttgccaggcgagtcaggacattaccaactatttaatttggtatcagcataaaccggggaaagcccctaaactccttatcttcgatgcatccaatttggaaacaggggtcccatcaaggttcagtggaagtgggtctgggacagattttactttcaccatcagcagcctgcagcctgaagattatgcaacgtattactgtcagcagtattataatctcccgctcactttcggcggagggaccaaggtggacatcaaa

SEQ ID NO: 116 - protein, 214 aa, Homo sapiens
DIQMTQSPSSLSASLGDSITITCQASQDITNYLIWYQHKPGKAPKLLIFDASNLETGVPSRFSGSGSGTDFTFTISSLQPEDYATYYCQQYYNLPLTFGGGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 117 - DNA, 642 bp, Homo sapiens
gacatccagatgacccagtctccatcctccctgtctgcttctttaggagacagcatcaccatcacttgccaggcgagtcaggacattaccaactatttaatttggtatcagcataaaccggggaaagcccctaaactccttatcttcgatgcatccaatttggaaacaggggtcccatcaaggttcagtggaagtgggtctgggacagattttactttcaccatcagcagcctgcagcctgaagattatgcaacgtattactgtcagcagtattataatctcccgctcactttcggcggagggaccaaggtggacatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 118 - protein, 10 aa, Homo sapiens
GGSVSSGRYY

SEQ ID NO: 119 - protein, 7 aa, Homo sapiens
ISNSGNT

SEQ ID NO: 120 - protein, 12 aa, Homo sapiens
ARGFIYDYWFDP

SEQ ID NO: 121 - protein, 7 aa, Homo sapiens
SGRYYWT

SEQ ID NO: 122 - protein, 16 aa, Homo sapiens
YISNSGNTNYNPSLKS

SEQ ID NO: 123 - protein, 10 aa, Homo sapiens
GFIYDYWFDP

SEQ ID NO: 124 - protein, 120 aa, Homo sapiens
QVQLQESGPGLVKPSETLSLTCSVSGGSVSSGRYYWTWIRQPPGKGLEWIGYISNSGNTNYNPSLKSRVTISLDTSKKQFSLSLSAVTAADTAVYYCARGFIYDYWFDPWGQGSLVTVSS

SEQ ID NO: 125 - DNA, 360 bp, Homo sapiens
caggtgcagctgcaggagtcgggcccaggactggtaaagccttcggagaccctgtccctcacatgtagtgtttctggtggctccgtcagcagtggtcgttactattggacctggatccggcagcccccagggaagggactggagtggattggatatatatctaatagtgggaacaccaactacaacccctccctcaagagccgagtcaccatatcccttgacacgtccaagaaacagttctccctgagcctgagtgctgtgaccgctgcggacacggccgtatattactgtgcgcgaggattcatctatgattactggttcgacccctggggccagggaagcctggtcaccgtctcctca

SEQ ID NO: 126 - protein, 447 aa, Homo sapiens
QVQLQESGPGLVKPSETLSLTCSVSGGSVSSGRYYWTWIRQPPGKGLEWIGYISNSGNTNYNPSLKSRVTISLDTSKKQFSLSLSAVTAADTAVYYCARGFIYDYWFDPWGQGSLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 127 - DNA, 1341 bp, Homo sapiens
caggtgcagctgcaggagtcgggcccaggactggtaaagccttcggagaccctgtccctcacatgtagtgtttctggtggctccgtcagcagtggtcgttactattggacctggatccggcagcccccagggaagggactggagtggattggatatatatctaatagtgggaacaccaactacaacccctccctcaagagccgagtcaccatatcccttgacacgtccaagaaacagttctccctgagcctgagtgctgtgaccgctgcggacacggccgtatattactgtgcgcgaggattcatctatgattactggttcgacccctggggccagggaagcctggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 128 - protein, 6 aa, Homo sapiens
QDIDNY

SEQ ID NO: 129 - protein, 9 aa, Homo sapiens
QQYGNLPIT

SEQ ID NO: 130 - protein, 11 aa, Homo sapiens
QASQDIDNYLN

SEQ ID NO: 131 - protein, 7 aa, Homo sapiens
DASKLET

SEQ ID NO: 132 - protein, 107 aa, Homo sapiens
DSQMTQSPSSLSASVGDRVTITCQASQDIDNYLNWYQQRPGKAPKLLIYDASKLETGVPSRFSGSGSGTDFTFTISSLQPEDFATYYCQQYGNLPITFGQGTRLDIK

SEQ ID NO: 133 - DNA, 321 bp, Homo sapiens
gacagccagatgacccagtctccatcctccctgtctgcttctgtaggagacagagtcaccatcacttgccaggcgagtcaggacattgacaactatttaaattggtatcagcagagaccagggaaagcccctaaactcctgatctacgatgcatccaagttggaaacgggggtcccatcaaggttcagtggaagtggatctgggacagattttactttcaccatcagcagcctgcaacctgaagattttgcaacatattactgtcaacaatatggtaatctcccgatcaccttcggccaagggacacgactggacattaaa

SEQ ID NO: 134 - protein, 214 aa, Homo sapiens
DSQMTQSPSSLSASVGDRVTITCQASQDIDNYLNWYQQRPGKAPKLLIYDASKLETGVPSRFSGSGSGTDFTFTISSLQPEDFATYYCQQYGNLPITFGQGTRLDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 135 - DNA, 642 bp, Homo sapiens
gacagccagatgacccagtctccatcctccctgtctgcttctgtaggagacagagtcaccatcacttgccaggcgagtcaggacattgacaactatttaaattggtatcagcagagaccagggaaagcccctaaactcctgatctacgatgcatccaagttggaaacgggggtcccatcaaggttcagtggaagtggatctgggacagattttactttcaccatcagcagcctgcaacctgaagattttgcaacatattactgtcaacaatatggtaatctcccgatcaccttcggccaagggacacgactggacattaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 136 - protein, 8 aa, Homo sapiens
GFTFNDHV

SEQ ID NO: 137 - protein, 8 aa, Homo sapiens
ISWNSDTI

SEQ ID NO: 138 - protein, 17 aa, Homo sapiens
AREKDGDFYYDYFAMDV

SEQ ID NO: 139 - protein, 5 aa, Homo sapiens
DHVIY

SEQ ID NO: 140 - protein, 17 aa, Homo sapiens
TISWNSDTIAYADSVKG

SEQ ID NO: 141 - protein, 15 aa, Homo sapiens
EKDGDFYYDYFAMDV

SEQ ID NO: 142 - protein, 124 aa, Homo sapiens
EVQLVESGGGLVQPGRSLRLSCAASGFTFNDHVIYWVRQVPGKGLEWVSTISWNSDTIAYADSVKGRFTISRDNAKNALYLQMNSLRTEDTALYYCAREKDGDFYYDYFAMDVWGQGTTVTVSS

SEQ ID NO: 143 - DNA, 372 bp, Homo sapiens
gaagtgcagttggtggagtctgggggaggcttggttcagcctggcaggtccctgagactctcctgtgcagcctctggattcacctttaatgatcatgtcatatattgggtccgacaagttccaggaaagggcctggagtgggtctcaactattagttggaatagtgataccattgcctatgcggactctgtgaagggccgattcaccatctccagagacaacgccaagaacgccctatatctgcaaatgaatagtctgagaactgaagacacggccttgtattactgtgcaagagaaaaagacggtgacttttactatgactacttcgctatggacgtctggggccaagggaccacggtcaccgtctcctca

SEQ ID NO: 144 - protein, 451 aa, Homo sapiens
EVQLVESGGGLVQPGRSLRLSCAASGFTFNDHVIYWVRQVPGKGLEWVSTISWNSDTIAYADSVKGRFTISRDNAKNALYLQMNSLRTEDTALYYCAREKDGDFYYDYFAMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 145 - DNA, 1353 bp, Homo sapiens
gaagtgcagttggtggagtctgggggaggcttggttcagcctggcaggtccctgagactctcctgtgcagcctctggattcacctttaatgatcatgtcatatattgggtccgacaagttccaggaaagggcctggagtgggtctcaactattagttggaatagtgataccattgcctatgcggactctgtgaagggccgattcaccatctccagagacaacgccaagaacgccctatatctgcaaatgaatagtctgagaactgaagacacggccttgtattactgtgcaagagaaaaagacggtgacttttactatgactacttcgctatggacgtctggggccaagggaccacggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 146 - protein, 9 aa, Homo sapiens
SSDVGYYNY

SEQ ID NO: 147 - protein, 3 aa, Homo sapiens
EVS

SEQ ID NO: 148 - protein, 10 aa, Homo sapiens
SSYAGSNKVV

SEQ ID NO: 149 - protein, 14 aa, Homo sapiens
TGTSSDVGYYNYVS

SEQ ID NO: 150 - protein, 7 aa, Homo sapiens
EVSKRPS

SEQ ID NO: 151 - protein, 110 aa, Homo sapiens
QSALTQPPSASGSPGQSVTLSCTGTSSDVGYYNYVSWYLQHPGKAPKLMIYEVSKRPSGVPDRFSGSKSANTASLTVSGLQAEDEADYYCSSYAGSNKVVFGGGTKVTVL

SEQ ID NO: 152 - DNA, 330 bp, Homo sapiens
cagtctgccctgactcagcctccctccgcgtccgggtctcctggacagtcagtcaccctctcctgcactggaaccagtagtgacgttggttattataactatgtctcctggtacctacagcacccaggcaaagcccccaaactcatgatttatgaggtcagtaagcggccctcaggggtccctgatcgcttttctggctccaagtctgccaacacggcctccctgaccgtctctgggctccaggctgaggatgaggctgattattattgcagctcatatgcaggcagcaacaaagtggtattcggcggagggaccaaggtgaccgtccta

SEQ ID NO: 153 - protein, 216 aa, Homo sapiens
QSALTQPPSASGSPGQSVTLSCTGTSSDVGYYNYVSWYLQHPGKAPKLMIYEVSKRPSGVPDRFSGSKSANTASLTVSGLQAEDEADYYCSSYAGSNKVVFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 154 - DNA, 648 bp, Homo sapiens
cagtctgccctgactcagcctccctccgcgtccgggtctcctggacagtcagtcaccctctcctgcactggaaccagtagtgacgttggttattataactatgtctcctggtacctacagcacccaggcaaagcccccaaactcatgatttatgaggtcagtaagcggccctcaggggtccctgatcgcttttctggctccaagtctgccaacacggcctccctgaccgtctctgggctccaggctgaggatgaggctgattattattgcagctcatatgcaggcagcaacaaagtggtattcggcggagggaccaaggtgaccgtcctaggacagccaaaagcagccccatccgtaactctgttcccacctagttcagaggagcttcaagcaaacaaagccacacttgtttgccttattagtgatttttatcccggtgccgtgacagttgcctggaaagctgatagctcaccagtgaaagctggcgtggagacaaccacaccatctaaacaaagcaataacaagtatgctgccagctcatatctgagtctcactccagaacaatggaagtctcatcggtcctatagctgtcaagtgacccacgaaggcagtaccgtcgagaagaccgtggcaccaacagagtgtagc

SEQ ID NO: 155 - protein, 8 aa, Homo sapiens
GFTFDDHV

SEQ ID NO: 156 - protein, 17 aa, Homo sapiens
AREKDGDFYYNYFVMDV

SEQ ID NO: 157 - protein, 5 aa, Homo sapiens
DHVMY

SEQ ID NO: 158 - protein, 17 aa, Homo sapiens
GISWNSDTIGYADAVKG

SEQ ID NO: 159 - protein, 15 aa, Homo sapiens
EKDGDFYYNYFVMDV

SEQ ID NO: 160 - protein, 124 aa, Homo sapiens
EVQLVESGGGLVQPGRSLRLSCAASGFTFDDHVMYWVRQGPGKGLEWVSGISWNSDTIGYADAVKGRFTISRDNAKNVLYLQMNSLRPEDTALYYCAREKDGDFYYNYFVMDVWGQGTTVTVSP

SEQ ID NO: 161 - DNA, 372 bp, Homo sapiens
gaagtgcagttggtggagtctgggggaggcttggtacagcctggcaggtccctgagactctcctgtgcagcctctggattcacctttgatgatcatgtcatgtattgggtccggcaaggtccagggaagggcctggagtgggtctcaggtattagttggaatagtgataccattggctatgcggacgctgtgaagggccgattcaccatctccagagacaacgccaagaacgtcctatatctgcaaatgaacagtctgagacctgaggacacggccttgtattactgtgcaagagagaaagacggtgacttttactataactacttcgttatggacgtctggggccaagggaccacggtcaccgtctcccca

SEQ ID NO: 162 - protein, 451 aa, Homo sapiens
EVQLVESGGGLVQPGRSLRLSCAASGFTFDDHVMYWVRQGPGKGLEWVSGISWNSDTIGYADAVKGRFTISRDNAKNVLYLQMNSLRPEDTALYYCAREKDGDFYYNYFVMDVWGQGTTVTVSPASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 163 - DNA, 1353 bp, Homo sapiens
gaagtgcagttggtggagtctgggggaggcttggtacagcctggcaggtccctgagactctcctgtgcagcctctggattcacctttgatgatcatgtcatgtattgggtccggcaaggtccagggaagggcctggagtgggtctcaggtattagttggaatagtgataccattggctatgcggacgctgtgaagggccgattcaccatctccagagacaacgccaagaacgtcctatatctgcaaatgaacagtctgagacctgaggacacggccttgtattactgtgcaagagagaaagacggtgacttttactataactacttcgttatggacgtctggggccaagggaccacggtcaccgtctccccagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 164 - protein, 9 aa, Homo sapiens
SSDVGFYNF

SEQ ID NO: 165 - protein, 14 aa, Homo sapiens
TGTSSDVGFYNFVS

SEQ ID NO: 166 - protein, 110 aa, Homo sapiens
QSALTQPPSASGSPGQSVTISCTGTSSDVGFYNFVSWYQQHPDKAPKVMIYEVSKRPSGVPDRFSGSKSGNTASLTVSGLQAEDEADYYCSSYAGSNKVVFGGGTKLTVL

SEQ ID NO: 167 - DNA, 330 bp, Homo sapiens
cagtctgccctgactcagcctccctccgcgtccgggtctcctggacagtcagtcaccatctcctgcactggaaccagcagtgacgttggtttttataactttgtctcctggtaccaacagcacccagacaaagcccccaaagtcatgatttatgaggtcagtaagcggccctcaggggtccctgatcgcttctctggctccaagtctggcaacacggcctccctgaccgtctctgggctccaggctgaggatgaggctgactattactgcagctcatatgcaggcagcaacaaagtggttttcggcggagggaccaagttgaccgtccta

SEQ ID NO: 168 - protein, 216 aa, Homo sapiens
QSALTQPPSASGSPGQSVTISCTGTSSDVGFYNFVSWYQQHPDKAPKVMIYEVSKRPSGVPDRFSGSKSGNTASLTVSGLQAEDEADYYCSSYAGSNKVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 169 - DNA, 648 bp, Homo sapiens
cagtctgccctgactcagcctccctccgcgtccgggtctcctggacagtcagtcaccatctcctgcactggaaccagcagtgacgttggtttttataactttgtctcctggtaccaacagcacccagacaaagcccccaaagtcatgatttatgaggtcagtaagcggccctcaggggtccctgatcgcttctctggctccaagtctggcaacacggcctccctgaccgtctctgggctccaggctgaggatgaggctgactattactgcagctcatatgcaggcagcaacaaagtggttttcggcggagggaccaagttgaccgtcctaggacagccaaaagcagccccatccgtaactctgttcccacctagttcagaggagcttcaagcaaacaaagccacacttgtttgccttattagtgatttttatcccggtgccgtgacagttgcctggaaagctgatagctcaccagtgaaagctggcgtggagacaaccacaccatctaaacaaagcaataacaagtatgctgccagctcatatctgagtctcactccagaacaatggaagtctcatcggtcctatagctgtcaagtgacccacgaaggcagtaccgtcgagaagaccgtggcaccaacagagtgtagc

SEQ ID NO: 170 - protein, 124 aa, Homo sapiens
EVQLVESGGGLVQPGRSLRLSCAASGFTFDDHVMYWVRQGPGKGLEWVSGISWNSDTIGYADAVKGRFTISRDNAKNVLYLQMNSLRPEDTALYYCAREKDGDFYYNYFVMDVWGQGTTVTVSS

SEQ ID NO: 171 - DNA, 372 bp, Homo sapiens
gaagtgcagttggtggagtctgggggaggcttggtacagcctggcaggtccctgagactctcctgtgcagcctctggattcacctttgatgatcatgtcatgtattgggtccggcaaggtccagggaagggcctggagtgggtctcaggtattagttggaatagtgataccattggctatgcggacgctgtgaagggccgattcaccatctccagagacaacgccaagaacgtcctatatctgcaaatgaacagtctgagacctgaggacacggccttgtattactgtgcaagagagaaagacggtgacttttactataactacttcgttatggacgtctggggccaagggaccacggtcaccgtctcctca

SEQ ID NO: 172 - protein, 451 aa, Homo sapiens
EVQLVESGGGLVQPGRSLRLSCAASGFTFDDHVMYWVRQGPGKGLEWVSGISWNSDTIGYADAVKGRFTISRDNAKNVLYLQMNSLRPEDTALYYCAREKDGDFYYNYFVMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 173 - DNA, 1353 bp, Homo sapiens
gaagtgcagttggtggagtctgggggaggcttggtacagcctggcaggtccctgagactctcctgtgcagcctctggattcacctttgatgatcatgtcatgtattgggtccggcaaggtccagggaagggcctggagtgggtctcaggtattagttggaatagtgataccattggctatgcggacgctgtgaagggccgattcaccatctccagagacaacgccaagaacgtcctatatctgcaaatgaacagtctgagacctgaggacacggccttgtattactgtgcaagagagaaagacggtgacttttactataactacttcgttatggacgtctggggccaagggaccacggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 174 - DNA, 330 bp, Homo sapiens; identical to SEQ ID NO: 167

SEQ ID NO: 175 - DNA, 648 bp, Homo sapiens; identical to SEQ ID NO: 169

SEQ ID NO: 176 - protein, 124 aa, Homo sapiens
EVQLVESGGGLVQPGRSLRLSCAASGFTFDDHVMYWVRQGPGKGLEWVSGISWNSDTIGYADAVKGRFTISRDNAKNVLYLQMNSLRPEDTALYYCAREKDGDFYYNYFVMDVWGQGTMVTVSS

SEQ ID NO: 177 - DNA, 372 bp, Homo sapiens
gaagtgcagttggtggagtctgggggaggcttggtacagcctggcaggtccctgagactctcctgtgcagcctctggattcacctttgatgatcatgtcatgtattgggtccggcaaggtccagggaagggcctggagtgggtctcaggtattagttggaatagtgataccattggctatgcggacgctgtgaagggccgattcaccatctccagagacaacgccaagaacgtcctatatctgcaaatgaacagtctgagacctgaggacacggccttgtattactgtgcaagagagaaagacggtgacttttactataactacttcgttatggacgtctggggccaagggacaatggtcaccgtctcttca

SEQ ID NO: 178 - protein, 451 aa, Homo sapiens
EVQLVESGGGLVQPGRSLRLSCAASGFTFDDHVMYWVRQGPGKGLEWVSGISWNSDTIGYADAVKGRFTISRDNAKNVLYLQMNSLRPEDTALYYCAREKDGDFYYNYFVMDVWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 179 - DNA, 1353 bp, Homo sapiens
gaagtgcagttggtggagtctgggggaggcttggtacagcctggcaggtccctgagactctcctgtgcagcctctggattcacctttgatgatcatgtcatgtattgggtccggcaaggtccagggaagggcctggagtgggtctcaggtattagttggaatagtgataccattggctatgcggacgctgtgaagggccgattcaccatctccagagacaacgccaagaacgtcctatatctgcaaatgaacagtctgagacctgaggacacggccttgtattactgtgcaagagagaaagacggtgacttttactataactacttcgttatggacgtctggggccaagggacaatggtcaccgtctcttcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 180 - DNA, 330 bp, Homo sapiens; identical to SEQ ID NO: 167

SEQ ID NO: 181 - DNA, 648 bp, Homo sapiens; identical to SEQ ID NO: 169

SEQ ID NO: 182 - protein, 124 aa, Homo sapiens
EVQLVESGGGLVQPGRSLRLSCAASGFTFDDHVMYWVRQAPGKGLEWVSGISWNSDTIGYADAVKGRFTISRDNAKNVLYLHMNSLRPEDTALYYCAREKDGDFYYNYFVMDVWGQGTTVTVSP

SEQ ID NO: 183 - DNA, 372 bp, Homo sapiens
gaagtgcagttagtggagtctgggggaggcttggtacagcctggcaggtccctgagactctcctgtgcagcctctggattcacctttgatgatcatgtcatgtattgggtccggcaagctccagggaagggcctggagtgggtctcaggtattagttggaatagtgataccattggctatgcggacgctgtgaagggccgattcaccatctccagagacaacgccaagaacgtcctatatctgcacatgaacagtctgagacctgaggacacggccttatattactgtgcgagagagaaagacggtgacttttactataactacttcgttatggacgtctggggccaagggaccacggtcaccgtctcccca

SEQ ID NO: 184 - protein, 451 aa, Homo sapiens
EVQLVESGGGLVQPGRSLRLSCAASGFTFDDHVMYWVRQAPGKGLEWVSGISWNSDTIGYADAVKGRFTISRDNAKNVLYLHMNSLRPEDTALYYCAREKDGDFYYNYFVMDVWGQGTTVTVSPASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 185 - DNA, 1353 bp, Homo sapiens
gaagtgcagttagtggagtctgggggaggcttggtacagcctggcaggtccctgagactctcctgtgcagcctctggattcacctttgatgatcatgtcatgtattgggtccggcaagctccagggaagggcctggagtgggtctcaggtattagttggaatagtgataccattggctatgcggacgctgtgaagggccgattcaccatctccagagacaacgccaagaacgtcctatatctgcacatgaacagtctgagacctgaggacacggccttatattactgtgcgagagagaaagacggtgacttttactataactacttcgttatggacgtctggggccaagggaccacggtcaccgtctccccagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 186 - DNA, 330 bp, Homo sapiens
cagtctgccctgactcagcctccctccgcgtccgggtctcctggacagtcagtcaccatctcctgcactggaaccagcagtgacgttggtttttataactttgtctcctggtaccaacagcacccagacaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaaagtggttttcggcggagggaccaagttgaccgtccta

SEQ ID NO: 187 - DNA, 648 bp, Homo sapiens
cagtctgccctgactcagcctccctccgcgtccgggtctcctggacagtcagtcaccatctcctgcactggaaccagcagtgacgttggtttttataactttgtctcctggtaccaacagcacccagacaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaaagtggttttcggcggagggaccaagttgaccgtcctaggacagccaaaagcagccccatccgtaactctgttcccacctagttcagaggagcttcaagcaaacaaagccacacttgtttgccttattagtgatttttatcccggtgccgtgacagttgcctggaaagctgatagctcaccagtgaaagctggcgtggagacaaccacaccatctaaacaaagcaataacaagtatgctgccagctcatatctgagtctcactccagaacaatggaagtctcatcggtcctatagctgtcaagtgacccacgaaggcagtaccgtcgagaagaccgtggcaccaacagagtgtagc

SEQ ID NO: 188 - protein, 8 aa, Homo sapiens
GFTFDEHV

SEQ ID NO: 189 - protein, 8 aa, Homo sapiens
ISWKSDII

SEQ ID NO: 190 - protein, 17 aa, Homo sapiens
AREKDGDFYYYYFAMDV

SEQ ID NO: 191 - protein, 5 aa, Homo sapiens
EHVIY

SEQ ID NO: 192 - protein, 17 aa, Homo sapiens
SISWKSDIIAYADSVKG

SEQ ID NO: 193 - protein, 15 aa, Homo sapiens
EKDGDFYYYYFAMDV

SEQ ID NO: 194 - protein, 124 aa, Homo sapiens
EVQLVESGGGLIQAGRSLRLSCAASGFTFDEHVIYWVRQIPGKGLEWISSISWKSDIIAYADSVKGRFTISRDNAKNALYLQMNSLRAEDTALYYCAREKDGDFYYYYFAMDVWGQGTTVTVSS

SEQ ID NO: 195 - DNA, 372 bp, Homo sapiens
gaggtgcagctggttgaatctggcggaggactgatccaggccggcagatctctgagactgtcttgtgccgcctccggcttcaccttcgatgagcacgtgatctactgggtccgacagatccctggcaaaggcctggaatggatctcctccatctcctggaagtccgacatcattgcctacgccgactccgtgaagggcagattcaccatctccagagacaacgccaagaacgccctgtacctgcagatgaactccctgagagccgaggacaccgctctgtactactgcgccagagagaaggacggcgacttttactactactatttcgccatggacgtgtggggccagggcaccacagtgacagtttcttct

SEQ ID NO: 196 - protein, 451 aa, Homo sapiens
EVQLVESGGGLIQAGRSLRLSCAASGFTFDEHVIYWVRQIPGKGLEWISSISWKSDIIAYADSVKGRFTISRDNAKNALYLQMNSLRAEDTALYYCAREKDGDFYYYYFAMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 197 - DNA, 1353 bp, Homo sapiens
gaggtgcagctggttgaatctggcggaggactgatccaggccggcagatctctgagactgtcttgtgccgcctccggcttcaccttcgatgagcacgtgatctactgggtccgacagatccctggcaaaggcctggaatggatctcctccatctcctggaagtccgacatcattgcctacgccgactccgtgaagggcagattcaccatctccagagacaacgccaagaacgccctgtacctgcagatgaactccctgagagccgaggacaccgctctgtactactgcgccagagagaaggacggcgacttttactactactatttcgccatggacgtgtggggccagggcaccacagtgacagtttcttctgccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 198 - DNA, 330 bp, Homo sapiens; identical to SEQ ID NO: 152

SEQ ID NO: 199 - DNA, 648 bp, Homo sapiens; identical to SEQ ID NO: 154

SEQ ID NO: 200 - protein, 8 aa, Homo sapiens
ITWKSDII

SEQ ID NO: 201 - protein, 5 aa, Homo sapiens
EHVMY

SEQ ID NO: 202 - protein, 17 aa, Homo sapiens
SITWKSDIIAYADSVKG

SEQ ID NO: 203 - protein, 124 aa, Homo sapiens
EVQLVESGGGLIQAGRSLRLSCAASGFTFDEHVMYWVRQIPGKGLEWISSITWKSDIIAYADSVKGRFTISRDNAKNALYLQMNSLRAEDTALYYCAREKDGDFYYYYFAMDVWGQGTTVTVSS

SEQ ID NO: 204 - DNA, 372 bp, Homo sapiens
gaggtgcagctggttgaatctggcggaggactgatccaggccggcagatctctgagactgtcttgtgccgcctccggcttcaccttcgatgagcacgtgatgtactgggtccgacagatccctggcaaaggcctggaatggatctcctccatcacctggaagtccgacatcattgcctacgccgactccgtgaagggcagattcaccatctccagagacaacgccaagaacgccctgtacctgcagatgaactccctgagagccgaggacaccgctctgtactactgcgccagagagaaggacggcgacttttactactactatttcgccatggacgtgtggggccagggcaccacagtgacagtttcttct

SEQ ID NO: 205 - protein, 451 aa, Homo sapiens
EVQLVESGGGLIQAGRSLRLSCAASGFTFDEHVMYWVRQIPGKGLEWISSITWKSDIIAYADSVKGRFTISRDNAKNALYLQMNSLRAEDTALYYCAREKDGDFYYYYFAMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 206 - DNA, 1353 bp, Homo sapiens
gaggtgcagctggttgaatctggcggaggactgatccaggccggcagatctctgagactgtcttgtgccgcctccggcttcaccttcgatgagcacgtgatgtactgggtccgacagatccctggcaaaggcctggaatggatctcctccatcacctggaagtccgacatcattgcctacgccgactccgtgaagggcagattcaccatctccagagacaacgccaagaacgccctgtacctgcagatgaactccctgagagccgaggacaccgctctgtactactgcgccagagagaaggacggcgacttttactactactatttcgccatggacgtgtggggccagggcaccacagtgacagtttcttctgccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 207 - DNA, 330 bp, Homo sapiens; identical to SEQ ID NO: 152

SEQ ID NO: 208 - DNA, 648 bp, Homo sapiens; identical to SEQ ID NO: 154

SEQ ID NO: 209 - DNA, 372 bp, Homo sapiens; identical to SEQ ID NO: 195

SEQ ID NO: 210 - protein, 451 aa, Homo sapiens; identical to SEQ ID NO: 196

SEQ ID NO: 211 - DNA, 1353 bp, Homo sapiens; identical to SEQ ID NO: 197

SEQ ID NO: 212 - protein, 9 aa, Homo sapiens
SSNVGYYNY

SEQ ID NO: 213 - protein, 3 aa, Homo sapiens
EVN

SEQ ID NO: 214 - protein, 14 aa, Homo sapiens
TGTSSNVGYYNYVS

SEQ ID NO: 215 - protein, 7 aa, Homo sapiens
EVNKRPS

SEQ ID NO: 216 - protein, 110 aa, Homo sapiens
QSALTQPPSASGSPGQSVTISCTGTSSNVGYYNYVSWYQQHPGKAPKLMIYEVNKRPSGVPDRFSGSKSANTASLTVSGLQADDEADYYCSSYAGSNKVVFGGGTKLTVL

SEQ ID NO: 217 - DNA, 330 bp, Homo sapiens
cagtctgctctgacccagcctccttctgcttctggctctcctggccagtccgtgaccatctcttgtaccggcacctcctccaacgtgggctactacaactacgtgtcctggtatcagcagcaccccggcaaggctcccaagctgatgatctacgaagtgaacaagcggccctctggcgtgcccgatagattctccggatccaagtccgccaataccgcctctctgaccgtgtctggactgcaggctgatgacgaggccgactactactgctcctcttacgccggctccaacaaggtggtgtttggcggcggaacaaagctgacagtgctg

SEQ ID NO: 218 - protein, 216 aa, Homo sapiens
QSALTQPPSASGSPGQSVTISCTGTSSNVGYYNYVSWYQQHPGKAPKLMIYEVNKRPSGVPDRFSGSKSANTASLTVSGLQADDEADYYCSSYAGSNKVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 219 - DNA, 648 bp, Homo sapiens
cagtctgctctgacccagcctccttctgcttctggctctcctggccagtccgtgaccatctcttgtaccggcacctcctccaacgtgggctactacaactacgtgtcctggtatcagcagcaccccggcaaggctcccaagctgatgatctacgaagtgaacaagcggccctctggcgtgcccgatagattctccggatccaagtccgccaataccgcctctctgaccgtgtctggactgcaggctgatgacgaggccgactactactgctcctcttacgccggctccaacaaggtggtgtttggcggcggaacaaagctgacagtgctgggacagccaaaagcagccccatccgtaactctgttcccacctagttcagaggagcttcaagcaaacaaagccacacttgtttgccttattagtgatttttatcccggtgccgtgacagttgcctggaaagctgatagctcaccagtgaaagctggcgtggagacaaccacaccatctaaacaaagcaataacaagtatgctgccagctcatatctgagtctcactccagaacaatggaagtctcatcggtcctatagctgtcaagtgacccacgaaggcagtaccgtcgagaagaccgtggcaccaacagagtgtagc

SEQ ID NO: 220 - DNA, 372 bp, Homo sapiens; identical to SEQ ID NO: 204

SEQ ID NO: 221 - protein, 451 aa, Homo sapiens; identical to SEQ ID NO: 205

SEQ ID NO: 222 - DNA, 1353 bp, Homo sapiens; identical to SEQ ID NO: 206

SEQ ID NO: 223 - DNA, 330 bp, Homo sapiens; identical to SEQ ID NO: 217

SEQ ID NO: 224 - DNA, 648 bp, Homo sapiens; identical to SEQ ID NO: 219

SEQ ID NO: 225 - protein, 8 aa, Homo sapiens
GFTFSNFD

SEQ ID NO: 226 - protein, 8 aa, Homo sapiens
IRYDETNI

SEQ ID NO: 227 - protein, 12 aa, Homo sapiens
ARGWTGSYVFDY

SEQ ID NO: 228 - protein, 5 aa, Homo sapiens
NFDMH

SEQ ID NO: 229 - protein, 17 aa, Homo sapiens
IIRYDETNIYYTESVKG

SEQ ID NO: 230 - protein, 10 aa, Homo sapiens
GWTGSYVFDY

SEQ ID NO: 231 - protein, 119 aa, Homo sapiens
QVHLVESGGAVVQPGRSLRLSCAASGFTFSNFDMHWVRQTPGKGLEWVTIIRYDETNIYYTESVKGRFTTSRDNSKNTLYLQMNSLRVEDTAVYYCARGWTGSYVFDYWGQGALVTVSS

SEQ ID NO: 232 - DNA, 357 bp, Homo sapiens
caggtgcacctggtggagtctgggggagccgtggtccagcctgggaggtccctgagactctcctgtgcagcgtctggattcaccttcagtaactttgacatgcactgggtccgccagactccaggcaaggggctggagtgggtgacaattattcggtatgatgaaactaatatatactatacagagtccgtgaagggccgtttcaccacctccagagacaattccaagaacacactgtatctgcaaatgaacagcctgcgagtcgaggacacggctgtgtattactgtgcgagagggtggactgggagttatgtctttgactactggggccagggagccctggtcaccgtctcctca

SEQ ID NO: 233 - protein, 446 aa, Homo sapiens
QVHLVESGGAVVQPGRSLRLSCAASGFTFSNFDMHWVRQTPGKGLEWVTIIRYDETNIYYTESVKGRFTTSRDNSKNTLYLQMNSLRVEDTAVYYCARGWTGSYVFDYWGQGALVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 234 - DNA, 1338 bp, Homo sapiens
caggtgcacctggtggagtctgggggagccgtggtccagcctgggaggtccctgagactctcctgtgcagcgtctggattcaccttcagtaactttgacatgcactgggtccgccagactccaggcaaggggctggagtgggtgacaattattcggtatgatgaaactaatatatactatacagagtccgtgaagggccgtttcaccacctccagagacaattccaagaacacactgtatctgcaaatgaacagcctgcgagtcgaggacacggctgtgtattactgtgcgagagggtggactgggagttatgtctttgactactggggccagggagccctggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 235 - protein, 8 aa, Homo sapiens
SSNIGNNA

SEQ ID NO: 236 - protein, 3 aa, Homo sapiens
YDD

SEQ ID NO: 237 - protein, 11 aa, Homo sapiens
AAWDDSLNGVV

SEQ ID NO: 238 - protein, 13 aa, Homo sapiens
SGGSSNIGNNAVN

SEQ ID NO: 239 - protein, 7 aa, Homo sapiens
YDDLLPS

SEQ ID NO: 240 - protein, 110 aa, Homo sapiens
QSVLTQPPSVSEAPRQRVTISCSGGSSNIGNNAVNWYQQVPGKAPKLLIHYDDLLPSGVSDRFSGSKSGTSASLAISGLQSEDEADYYCAAWDDSLNGVVFGGGTKLTVL

SEQ ID NO: 241 - DNA, 330 bp, Homo sapiens
cagtctgtgctgactcagccaccctcggtgtctgaagcccccaggcagagggtcaccatctcctgttctggaggcagttccaacatcggaaataatgctgtaaactggtaccagcaggtcccaggaaaggctcccaaactcctcatccattatgatgatctactgccctcaggggtctctgaccgattctctggctccaagtctggcacctcagcctccctggccatcagtggactccagtctgaggatgaggctgattattactgtgcagcatgggatgacagcctgaatggtgtggtattcggcggaggtaccaagctgaccgtccta

SEQ ID NO: 242 - protein, 216 aa, Homo sapiens
QSVLTQPPSVSEAPRQRVTISCSGGSSNIGNNAVNWYQQVPGKAPKLLIHYDDLLPSGVSDRFSGSKSGTSASLAISGLQSEDEADYYCAAWDDSLNGVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 243 - DNA, 648 bp, Homo sapiens
cagtctgtgctgactcagccaccctcggtgtctgaagcccccaggcagagggtcaccatctcctgttctggaggcagttccaacatcggaaataatgctgtaaactggtaccagcaggtcccaggaaaggctcccaaactcctcatccattatgatgatctactgccctcaggggtctctgaccgattctctggctccaagtctggcacctcagcctccctggccatcagtggactccagtctgaggatgaggctgattattactgtgcagcatgggatgacagcctgaatggtgtggtattcggcggaggtaccaagctgaccgtcctaggacagccaaaagcagccccatccgtaactctgttcccacctagttcagaggagcttcaagcaaacaaagccacacttgtttgccttattagtgatttttatcccggtgccgtgacagttgcctggaaagctgatagctcaccagtgaaagctggcgtggagacaaccacaccatctaaacaaagcaataacaagtatgctgccagctcatatctgagtctcactccagaacaatggaagtctcatcggtcctatagctgtcaagtgacccacgaaggcagtaccgtcgagaagaccgtggcaccaacagagtgtagc

SEQ ID NO: 244 - protein, 8 aa, Homo sapiens
GYTFTTFG

SEQ ID NO: 245 - protein, 8 aa, Homo sapiens
ISGYNGNT

SEQ ID NO: 246 - protein, 12 aa, Homo sapiens
ARDRAIAPRFDP

SEQ ID NO: 247 - protein, 5 aa, Homo sapiens
TFGIV

SEQ ID NO: 248 - protein, 17 aa, Homo sapiens
WISGYNGNTKYAQNLQG

SEQ ID NO: 249 - protein, 10 aa, Homo sapiens
DRAIAPRFDP

SEQ ID NO: 250 - protein, 119 aa, Homo sapiens
QLQLVQSGAEVKKPGASVKVSCKASGYTFTTFGIVWVRQAPGQGLEWMGWISGYNGNTKYAQNLQGRVTMTTDTSTSTAYMELRSLRSDDTAIYYCARDRAIAPRFDPWGQGTLVTVSS

SEQ ID NO: 251 - DNA, 357 bp, Homo sapiens
cagcttcagctggtgcagtctggagctgaggtgaagaagcctggggcctcagtgaaggtctcctgcaaggcttctggttacacctttaccacctttggtatcgtctgggtgcgacaggcccctggacaagggcttgagtggatgggatggatcagcggttacaatggtaacacaaagtatgcacagaatctccagggcagagtcaccatgaccacagacacatccacgagcacagcctacatggaactgaggagcctgagatctgacgacacggccatatattactgtgcgagagatagggctatagcacctcgcttcgacccctggggccagggaaccctggtcaccgtctcctca

SEQ ID NO: 252 - protein, 446 aa, Homo sapiens
QLQLVQSGAEVKKPGASVKVSCKASGYTFTTFGIVWVRQAPGQGLEWMGWISGYNGNTKYAQNLQGRVTMTTDTSTSTAYMELRSLRSDDTAIYYCARDRAIAPRFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 253 - DNA, 1338 bp, Homo sapiens
cagcttcagctggtgcagtctggagctgaggtgaagaagcctggggcctcagtgaaggtctcctgcaaggcttctggttacacctttaccacctttggtatcgtctgggtgcgacaggcccctggacaagggcttgagtggatgggatggatcagcggttacaatggtaacacaaagtatgcacagaatctccagggcagagtcaccatgaccacagacacatccacgagcacagcctacatggaactgaggagcctgagatctgacgacacggccatatattactgtgcgagagatagggctatagcacctcgcttcgacccctggggccagggaaccctggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 254 - protein, 6 aa, Homo sapiens
NLGDNF

SEQ ID NO: 255 - protein, 3 aa, Homo sapiens
QDS

SEQ ID NO: 256 - protein, 9 aa, Homo sapiens
QAWDSSTVV

SEQ ID NO: 257 - protein, 11 aa, Homo sapiens
SGDNLGDNFAC

SEQ ID NO: 258 - protein, 7 aa, Homo sapiens
QDSKRPS

SEQ ID NO: 259 - protein, 106 aa, Homo sapiens
SYELTQPPSVSVSPGQAASIPCSGDNLGDNFACWYQQKPGQSPVLVIYQDSKRPSGIPERFSGSNSGNTATLTINGTQAMDEADYYCQAWDSSTVVFGGGTKLTVL

SEQ ID NO: 260 - DNA, 318 bp, Homo sapiens
tcctatgagctgactcagccaccctcagtgtccgtgtccccaggacaggcagccagcatcccctgctctggagataatttgggggataactttgcttgctggtatcagcagaagccaggccagtctcctgtgttggtcatctatcaagatagcaagcggccctcagggatccctgagcgattctctggctccaactctgggaacacagccactctgaccatcaacgggacccaggctatggatgaggctgactattactgtcaggcgtgggacagcagcactgtggtattcggcggagggaccaagctgaccgtccta

SEQ ID NO: 261 - protein, 212 aa, Homo sapiens
SYELTQPPSVSVSPGQAASIPCSGDNLGDNFACWYQQKPGQSPVLVIYQDSKRPSGIPERFSGSNSGNTATLTINGTQAMDEADYYCQAWDSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 262 - DNA, 636 bp, Homo sapiens
tcctatgagctgactcagccaccctcagtgtccgtgtccccaggacaggcagccagcatcccctgctctggagataatttgggggataactttgcttgctggtatcagcagaagccaggccagtctcctgtgttggtcatctatcaagatagcaagcggccctcagggatccctgagcgattctctggctccaactctgggaacacagccactctgaccatcaacgggacccaggctatggatgaggctgactattactgtcaggcgtgggacagcagcactgtggtattcggcggagggaccaagctgaccgtcctaggacagccaaaagcagccccatccgtaactctgttcccacctagttcagaggagcttcaagcaaacaaagccacacttgtttgccttattagtgatttttatcccggtgccgtgacagttgcctggaaagctgatagctcaccagtgaaagctggcgtggagacaaccacaccatctaaacaaagcaataacaagtatgctgccagctcatatctgagtctcactccagaacaatggaagtctcatcggtcctatagctgtcaagtgacccacgaaggcagtaccgtcgagaagaccgtggcaccaacagagtgtagc

SEQ ID NO: 263 - protein, 8 aa, Homo sapiens
ISYDGSDK

SEQ ID NO: 264 - protein, 12 aa, Homo sapiens
AKDGYGSSLFDH

SEQ ID NO: 265 - protein, 17 aa, Homo sapiens
IISYDGSDKYYEDSVKG

SEQ ID NO: 266 - protein, 10 aa, Homo sapiens
DGYGSSLFDH

SEQ ID NO: 267 - protein, 119 aa, Homo sapiens
QVQLVESGGGVVQPGRSLRLSCAASGFTFSNFDMHWVRQAPGKGLEWVAIISYDGSDKYYEDSVKGRFTISRDNSKNTLYLQMNSLRAEDTAIYYCAKDGYGSSLFDHWGQGTLVTVSS

SEQ ID NO: 268 - DNA, 357 bp, Homo sapiens
caggtgcagctggtggagtctgggggaggcgtggtccagcctgggaggtccctgagactctcctgtgcagcctcgggattcaccttcagtaactttgacatgcactgggtccgccaggctccaggcaaggggctggagtgggtggcaattatatcatatgatggaagtgataaatattatgaagactccgtgaagggccgattcaccatctccagagacaattccaaaaacacgctgtatctgcaaatgaacagcctgagagctgaggacacggctatttattattgtgcgaaagatgggtatggcagttccctctttgaccactggggccagggaaccctggtcaccgtctcctca

SEQ ID NO: 269 - protein, 446 aa, Homo sapiens
QVQLVESGGGVVQPGRSLRLSCAASGFTFSNFDMHWVRQAPGKGLEWVAIISYDGSDKYYEDSVKGRFTISRDNSKNTLYLQMNSLRAEDTAIYYCAKDGYGSSLFDHWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 270 - DNA, 1338 bp, Homo sapiens
caggtgcagctggtggagtctgggggaggcgtggtccagcctgggaggtccctgagactctcctgtgcagcctcgggattcaccttcagtaactttgacatgcactgggtccgccaggctccaggcaaggggctggagtgggtggcaattatatcatatgatggaagtgataaatattatgaagactccgtgaagggccgattcaccatctccagagacaattccaaaaacacgctgtatctgcaaatgaacagcctgagagctgaggacacggctatttattattgtgcgaaagatgggtatggcagttccctctttgaccactggggccagggaaccctggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 271 - protein, 11 aa, Homo sapiens
AVWDDSLNGVL

SEQ ID NO: 272 - protein, 13 aa, Homo sapiens
SGSSSNIGNNAVN

SEQ ID NO: 273 - protein, 110 aa, Homo sapiens
QSVLTQPPSVSEAPRQRVTISCSGSSSNIGNNAVNWFQQLPGEVPKLLIYYDDLLPSGVSDRFSGSKSGTSASLAISGLQSEDEADYYCAVWDDSLNGVLFGGGTKLTVL

SEQ ID NO: 274 - DNA, 330 bp, Homo sapiens
cagtctgtgctgactcagccaccctcggtgtctgaagcccccaggcagagggtcaccatctcctgttctggaagcagctccaacatcggaaataatgctgtaaactggttccagcagctcccaggagaggttcccaaactcctcatctattatgatgatctgctgccctcaggagtctctgaccgattctctggctccaagtctggcacctcagcctccctggccatcagtgggctccagtctgaggatgaggctgattattactgtgcagtttgggatgacagcctgaatggtgtcctattcggcggagggaccaagctgaccgtccta

SEQ ID NO: 275 - protein, 216 aa, Homo sapiens
QSVLTQPPSVSEAPRQRVTISCSGSSSNIGNNAVNWFQQLPGEVPKLLIYYDDLLPSGVSDRFSGSKSGTSASLAISGLQSEDEADYYCAVWDDSLNGVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 276 - DNA, 648 bp, Homo sapiens
cagtctgtgctgactcagccaccctcggtgtctgaagcccccaggcagagggtcaccatctcctgttctggaagcagctccaacatcggaaataatgctgtaaactggttccagcagctcccaggagaggttcccaaactcctcatctattatgatgatctgctgccctcaggagtctctgaccgattctctggctccaagtctggcacctcagcctccctggccatcagtgggctccagtctgaggatgaggctgattattactgtgcagtttgggatgacagcctgaatggtgtcctattcggcggagggaccaagctgaccgtcctaggacagccaaaagcagccccatccgtaactctgttcccacctagttcagaggagcttcaagcaaacaaagccacacttgtttgccttattagtgatttttatcccggtgccgtgacagttgcctggaaagctgatagctcaccagtgaaagctggcgtggagacaaccacaccatctaaacaaagcaataacaagtatgctgccagctcatatctgagtctcactccagaacaatggaagtctcatcggtcctatagctgtcaagtgacccacgaaggcagtaccgtcgagaagaccgtggcaccaacagagtgtagc

SEQ ID NO: 277 - protein, 10 aa, Homo sapiens
GDSISSSHYF

SEQ ID NO: 278 - protein, 7 aa, Homo sapiens
MYYSGST

SEQ ID NO: 279 - protein, 14 aa, Homo sapiens
VRHNNWGLDNYFDY

SEQ ID NO: 280 - protein, 7 aa, Homo sapiens
SSHYFWG

SEQ ID NO: 281 - protein, 16 aa, Homo sapiens
SMYYSGSTYYNPSLKS

SEQ ID NO: 282 - protein, 12 aa, Homo sapiens
HNNWGLDNYFDY

SEQ ID NO: 283 - protein, 122 aa, Homo sapiens
QLQLQESGPGLVKPAETLSLMCTVSGDSISSSHYFWGWIRQPPGKGLEWIGSMYYSGSTYYNPSLKSRVTISVDTSNNQFSLKLRSVTAADTAVYYCVRHNNWGLDNYFDYWGQGTLVTVSS

SEQ ID NO: 284 - DNA, 366 bp, Homo sapiens
cagctgcagctgcaggagtcgggcccaggactggtgaagcctgcggagaccctgtccctcatgtgcactgtctctggtgactccatcagtagtagtcattacttctggggctggatccgccagcccccagggaagggcctggagtggattgggagtatgtattatagtgggagcacctactacaacccgtccctcaagagtcgagtcaccatatccgtagacacgtccaacaaccagttttccctgaagctgaggtctgtgaccgccgcagacacggctgtgtattattgtgtgagacataataattggggattggacaactactttgactactggggccagggaaccctggtcaccgtctcctca

SEQ ID NO: 285 - protein, 449 aa, Homo sapiens
QLQLQESGPGLVKPAETLSLMCTVSGDSISSSHYFWGWIRQPPGKGLEWIGSMYYSGSTYYNPSLKSRVTISVDTSNNQFSLKLRSVTAADTAVYYCVRHNNWGLDNYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 286 - DNA, 1347 bp, Homo sapiens
cagctgcagctgcaggagtcgggcccaggactggtgaagcctgcggagaccctgtccctcatgtgcactgtctctggtgactccatcagtagtagtcattacttctggggctggatccgccagcccccagggaagggcctggagtggattgggagtatgtattatagtgggagcacctactacaacccgtccctcaagagtcgagtcaccatatccgtagacacgtccaacaaccagttttccctgaagctgaggtctgtgaccgccgcagacacggctgtgtattattgtgtgagacataataattggggattggacaactactttgactactggggccagggaaccctggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 287 - protein, 6 aa, Homo sapiens
ALPDQY

SEQ ID NO: 288 - protein, 3 aa, Homo sapiens
KDS

SEQ ID NO: 289 - protein, 11 aa, Homo sapiens
QSADSSGSYAV

SEQ ID NO: 290 - protein, 11 aa, Homo sapiens
SADALPDQYAY

SEQ ID NO: 291 - protein, 7 aa, Homo sapiens
KDSERPS

SEQ ID NO: 292 - protein, 108 aa, Homo sapiens
SYELTQPPSVSVSPGQTARITCSADALPDQYAYWYQQKPGQAPLLVIYKDSERPSGIPERFSGSSSGTIVTLTIRGVQAEDEADYYCQSADSSGSYAVFGGGTKLTVL

SEQ ID NO: 293 - DNA, 324 bp, Homo sapiens
tcctatgagctgacgcagccaccctcggtgtcagtgtccccaggacagacggccaggatcacctgctctgcagatgcattgccagaccaatatgcttattggtaccagcagaagccaggccaggcccctctgttggtcatatataaagacagtgagaggccctcagggatccctgagcgattctctggctccagctcagggacaatagtcacgttgaccatccgtggagtccaggcagaagacgaggctgactattactgtcaatcagcagacagcagtggttcttatgcggtattcggcggagggaccaagttgaccgtccta

SEQ ID NO: 294 - protein, 214 aa, Homo sapiens
SYELTQPPSVSVSPGQTARITCSADALPDQYAYWYQQKPGQAPLLVIYKDSERPSGIPERFSGSSSGTIVTLTIRGVQAEDEADYYCQSADSSGSYAVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 295 - DNA, 642 bp, Homo sapiens
tcctatgagctgacgcagccaccctcggtgtcagtgtccccaggacagacggccaggatcacctgctctgcagatgcattgccagaccaatatgcttattggtaccagcagaagccaggccaggcccctctgttggtcatatataaagacagtgagaggccctcagggatccctgagcgattctctggctccagctcagggacaatagtcacgttgaccatccgtggagtccaggcagaagacgaggctgactattactgtcaatcagcagacagcagtggttcttatgcggtattcggcggagggaccaagttgaccgtcctaggacagccaaaagcagccccatccgtaactctgttcccacctagttcagaggagcttcaagcaaacaaagccacacttgtttgccttattagtgatttttatcccggtgccgtgacagttgcctggaaagctgatagctcaccagtgaaagctggcgtggagacaaccacaccatctaaacaaagcaataacaagtatgctgccagctcatatctgagtctcactccagaacaatggaagtctcatcggtcctatagctgtcaagtgacccacgaaggcagtaccgtcgagaagaccgtggcaccaacagagtgtagc

SEQ ID NO: 296 - protein, 8 aa, Homo sapiens
GFTFSDYY

SEQ ID NO: 297 - protein, 8 aa, Homo sapiens
ISSSGRTR

SEQ ID NO: 298 - protein, 13 aa, Homo sapiens
ARAQLRYFDWLDY

SEQ ID NO: 299 - protein, 5 aa, Homo sapiens
DYYMG

SEQ ID NO: 300 - protein, 17 aa, Homo sapiens
HISSSGRTRYYADSVKG

SEQ ID NO: 301 - protein, 11 aa, Homo sapiens
AQLRYFDWLDY

SEQ ID NO: 302 - protein, 120 aa, Homo sapiens
QVQLVESGGGLVKPGGSLRLSCAAFGFTFSDYYMGWIRQAPGKGLEWVSHISSSGRTRYYADSVKGRFTISRDNAKNALYLQMDSLRAEDTAVFYCARAQLRYFDWLDYWGQGTLVTVSS

SEQ ID NO: 303 - DNA, 360 bp, Homo sapiens
caggtgcagctggtggagtctgggggaggcctggtcaagcctggagggtccctgagactctcctgtgcagcctttggattcaccttcagtgactactacatgggctggatccgccaggctccagggaaggggctggagtgggtttcacacattagtagtagtggtaggaccaggtactacgcagactctgtgaagggccgattcaccatctccagggacaacgccaagaatgcactgtatctgcaaatggacagcctgagagccgaagacacggccgtattttactgtgcgagagcccaattacgatattttgactggcttgactactggggccagggaaccctggtcaccgtctcctca

SEQ ID NO: 304 - protein, 447 aa, Homo sapiens
QVQLVESGGGLVKPGGSLRLSCAAFGFTFSDYYMGWIRQAPGKGLEWVSHISSSGRTRYYADSVKGRFTISRDNAKNALYLQMDSLRAEDTAVFYCARAQLRYFDWLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 305 - DNA, 1341 bp, Homo sapiens
caggtgcagctggtggagtctgggggaggcctggtcaagcctggagggtccctgagactctcctgtgcagcctttggattcaccttcagtgactactacatgggctggatccgccaggctccagggaaggggctggagtgggtttcacacattagtagtagtggtaggaccaggtactacgcagactctgtgaagggccgattcaccatctccagggacaacgccaagaatgcactgtatctgcaaatggacagcctgagagccgaagacacggccgtattttactgtgcgagagcccaattacgatattttgactggcttgactactggggccagggaaccctggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 306 - protein, 8 aa, Homo sapiens
GSNIGNNY

SEQ ID NO: 307 - protein, 3 aa, Homo sapiens
DNN

SEQ ID NO: 308 - protein, 11 aa, Homo sapiens
GTWDSSLSAGV

SEQ ID NO: 309 - protein, 13 aa, Homo sapiens
SGSGSNIGNNYVS

SEQ ID NO: 310 - protein, 7 aa, Homo sapiens
DNNKRPS

SEQ ID NO: 311 - protein, 110 aa, Homo sapiens
QSVLTQPPSVSAAPGQKVTISCSGSGSNIGNNYVSWYQQVPGTAPKLLIYDNNKRPSGIPDRFSGSKSGTSATLGITGLQTGDEADYYCGTWDSSLSAGVFGGGTKLTVL

SEQ ID NO: 312 - DNA, 330 bp, Homo sapiens
cagtctgtgttgacgcagccgccctcagtgtctgcggccccaggacagaaggtcaccatctcctgctctggaagcggctccaacattgggaataattatgtatcctggtaccagcaggtcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctggggtgttcggcggagggaccaagctgaccgtccta

SEQ ID NO: 313 - protein, 216 aa, Homo sapiens
QSVLTQPPSVSAAPGQKVTISCSGSGSNIGNNYVSWYQQVPGTAPKLLIYDNNKRPSGIPDRFSGSKSGTSATLGITGLQTGDEADYYCGTWDSSLSAGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 314 - DNA, 648 bp, Homo sapiens
cagtctgtgttgacgcagccgccctcagtgtctgcggccccaggacagaaggtcaccatctcctgctctggaagcggctccaacattgggaataattatgtatcctggtaccagcaggtcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctggggtgttcggcggagggaccaagctgaccgtcctaggacagccaaaagcagccccatccgtaactctgttcccacctagttcagaggagcttcaagcaaacaaagccacacttgtttgccttattagtgatttttatcccggtgccgtgacagttgcctggaaagctgatagctcaccagtgaaagctggcgtggagacaaccacaccatctaaacaaagcaataacaagtatgctgccagctcatatctgagtctcactccagaacaatggaagtctcatcggtcctatagctgtcaagtgacccacgaaggcagtaccgtcgagaagaccgtggcaccaacagagtgtagc

SEQ ID NO: 315 - protein, 8 aa, Homo sapiens
GFTFSTYT

SEQ ID NO: 316 - protein, 8 aa, Homo sapiens
ISIRNSII

SEQ ID NO: 317 - protein, 16 aa, Homo sapiens
AREEFCGTTSCYFLDY

SEQ ID NO: 318 - protein, 5 aa, Homo sapiens
TYTMN

SEQ ID NO: 319 - protein, 17 aa, Homo sapiens
YISIRNSIIDYADSVKG

SEQ ID NO: 320 - protein, 14 aa, Homo sapiens
EEFCGTTSCYFLDY

SEQ ID NO: 321 - protein, 123 aa, Homo sapiens
EVRLVESGGGLVQSGGSLRLSCAASGFTFSTYTMNWVRQAPGKGLEWVSYISIRNSIIDYADSVKGRFTISRDNAKNSLYLQMNSLRDEDTAVYYCAREEFCGTTSCYFLDYWGQGILVTVSS

SEQ ID NO: 322 - DNA, 369 bp, Homo sapiens
gaggtgcggctggtggagtctgggggaggcttggttcagtctggggggtccctgagactctcctgtgcagcctctggattcaccttcagtacctataccatgaactgggtccgccaggctccagggaaggggctggagtgggtttcatacattagtattaggaatagtatcatagactacgcagactctgtgaagggccgcttcaccatctccagagacaatgccaagaactcactgtatctgcaaatgaacagcctgagagacgaggacacggctgtttattattgtgcgagagaggagttttgtggtactaccagctgctatttccttgactactggggccagggaatcctggtcaccgtctcctca

SEQ ID NO: 323 - protein, 450 aa, Homo sapiens
EVRLVESGGGLVQSGGSLRLSCAASGFTFSTYTMNWVRQAPGKGLEWVSYISIRNSIIDYADSVKGRFTISRDNAKNSLYLQMNSLRDEDTAVYYCAREEFCGTTSCYFLDYWGQGILVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 324 - DNA, 1350 bp, Homo sapiens
gaggtgcggctggtggagtctgggggaggcttggttcagtctggggggtccctgagactctcctgtgcagcctctggattcaccttcagtacctataccatgaactgggtccgccaggctccagggaaggggctggagtgggtttcatacattagtattaggaatagtatcatagactacgcagactctgtgaagggccgcttcaccatctccagagacaatgccaagaactcactgtatctgcaaatgaacagcctgagagacgaggacacggctgtttattattgtgcgagagaggagttttgtggtactaccagctgctatttccttgactactggggccagggaatcctggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 325 - protein, 9 aa, Homo sapiens
SSNIGAGYD

SEQ ID NO: 326 - protein, 3 aa, Homo sapiens
GNS

SEQ ID NO: 327 - protein, 11 aa, Homo sapiens
QSYDSSLSGYV

SEQ ID NO: 328 - protein, 14 aa, Homo sapiens
TGSSSNIGAGYDVH

SEQ ID NO: 329 - protein, 7 aa, Homo sapiens
GNSNRPS

SEQ ID NO: 330 - protein, 111 aa, Homo sapiens
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVFGTGTKVTVL

SEQ ID NO: 331 - DNA, 333 bp, Homo sapiens
cagtctgtgctgacgcagccgccctcagtgtctggggccccaggtcagagggtcaccatctcctgcactgggagcagctccaacatcggggcaggttatgatgtacactggtaccagcaacttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttatgtcttcggaactgggaccaaggtcaccgtccta

SEQ ID NO: 332 - protein, 217 aa, Homo sapiens
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 333 - DNA, 651 bp, Homo sapiens
cagtctgtgctgacgcagccgccctcagtgtctggggccccaggtcagagggtcaccatctcctgcactgggagcagctccaacatcggggcaggttatgatgtacactggtaccagcaacttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttatgtcttcggaactgggaccaaggtcaccgtcctaggacagccaaaagcagccccatccgtaactctgttcccacctagttcagaggagcttcaagcaaacaaagccacacttgtttgccttattagtgatttttatcccggtgccgtgacagttgcctggaaagctgatagctcaccagtgaaagctggcgtggagacaaccacaccatctaaacaaagcaataacaagtatgctgccagctcatatctgagtctcactccagaacaatggaagtctcatcggtcctatagctgtcaagtgacccacgaaggcagtaccgtcgagaagaccgtggcaccaacagagtgtagc

SEQ ID NO: 334 - protein, 8 aa, Homo sapiens
ISSSGGNR

SEQ ID NO: 335 - protein, 13 aa, Homo sapiens
ARGGLRYFDWADF

SEQ ID NO: 336 - protein, 5 aa, Homo sapiens
DYYMS

SEQ ID NO: 337 - protein, 17 aa, Homo sapiens
YISSSGGNRYYADSVKG

SEQ ID NO: 338 - protein, 11 aa, Homo sapiens
GGLRYFDWADF

SEQ ID NO: 339 - protein, 120 aa, Homo sapiens
QVQLVESGGGLVKPGGSLRLSCAASGFTFSDYYMSWIRQAPGKGLEWVSYISSSGGNRYYADSVKGRFTISRDNAKNSLYLQMNSLRAEDTAVYYCARGGLRYFDWADFWGQGTLVTVSS

SEQ ID NO: 340 - DNA, 360 bp, Homo sapiens
caggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtggtaacagatactatgcagactctgtgaagggccgattcaccatctccagggacaacgccaagaactcactgtatctgcaaatgaacagcctgagagccgaggacacggccgtgtattactgtgcgagagggggattacgatattttgactgggctgacttctggggccagggaaccctggtcaccgtctcctca

SEQ ID NO: 341 - protein, 447 aa, Homo sapiens
QVQLVESGGGLVKPGGSLRLSCAASGFTFSDYYMSWIRQAPGKGLEWVSYISSSGGNRYYADSVKGRFTISRDNAKNSLYLQMNSLRAEDTAVYYCARGGLRYFDWADFWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 342 - DNA, 1341 bp, Homo sapiens
caggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtggtaacagatactatgcagactctgtgaagggccgattcaccatctccagggacaacgccaagaactcactgtatctgcaaatgaacagcctgagagccgaggacacggccgtgtattactgtgcgagagggggattacgatattttgactgggctgacttctggggccagggaaccctggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 343 - protein, 8 aa, Homo sapiens
SSNIGNNY

SEQ ID NO: 344 - protein, 11 aa, Homo sapiens
GTWDNSLSAGV

SEQ ID NO: 345 - protein, 13 aa, Homo sapiens
SGSSSNIGNNYVS

SEQ ID NO: 346 - protein, 110 aa, Homo sapiens
QSVLTQPPSVSAAPGQKVTISCSGSSSNIGNNYVSWYQQLPGTAPKLLIYDNNKRPSGIPDRFSGSKSGTSATLGIPELQTGDEADYYCGTWDNSLSAGVFGGGTKLTVL

SEQ ID NO: 347 - DNA, 330 bp, Homo sapiens
cagtctgtgttgacgcagccgccctcagtgtctgcggccccaggacagaaggtcaccatctcctgctctggaagcagctccaacattgggaataattatgtatcctggtatcagcagctcccaggaacagcccccaaactcctcatttatgacaataataagcgaccctcggggattcctgaccgattctctggctccaagtctggcacgtcagccaccctgggcatccccgaactccagactggggacgaggccgattattactgcggaacatgggataacagcctgagtgctggggtgttcggcggagggaccaagctgaccgtccta

SEQ ID NO: 348 - protein, 216 aa, Homo sapiens
QSVLTQPPSVSAAPGQKVTISCSGSSSNIGNNYVSWYQQLPGTAPKLLIYDNNKRPSGIPDRFSGSKSGTSATLGIPELQTGDEADYYCGTWDNSLSAGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 349 - DNA, 648 bp, Homo sapiens
cagtctgtgttgacgcagccgccctcagtgtctgcggccccaggacagaaggtcaccatctcctgctctggaagcagctccaacattgggaataattatgtatcctggtatcagcagctcccaggaacagcccccaaactcctcatttatgacaataataagcgaccctcggggattcctgaccgattctctggctccaagtctggcacgtcagccaccctgggcatccccgaactccagactggggacgaggccgattattactgcggaacatgggataacagcctgagtgctggggtgttcggcggagggaccaagctgaccgtcctaggacagccaaaagcagccccatccgtaactctgttcccacctagttcagaggagcttcaagcaaacaaagccacacttgtttgccttattagtgatttttatcccggtgccgtgacagttgcctggaaagctgatagctcaccagtgaaagctggcgtggagacaaccacaccatctaaacaaagcaataacaagtatgctgccagctcatatctgagtctcactccagaacaatggaagtctcatcggtcctatagctgtcaagtgacccacgaaggcagtaccgtcgagaagaccgtggcaccaacagagtgtagc

SEQ ID NO: 350 - protein, 8 aa, Homo sapiens
GYTFTNFG

SEQ ID NO: 351 - protein, 8 aa, Homo sapiens
ISAYSGFT

SEQ ID NO: 352 - protein, 14 aa, Homo sapiens
AREGYSNYEDWFDP

SEQ ID NO: 353 - protein, 5 aa, Homo sapiens
NFGIS

SEQ ID NO: 354 - protein, 17 aa, Homo sapiens
WISAYSGFTNFAQKFQG

SEQ ID NO: 355 - protein, 12 aa, Homo sapiens
EGYSNYEDWFDP

SEQ ID NO: 356 - protein, 121 aa, Homo sapiens
QVQLVQSGPELKKPGASVKVSCKASGYTFTNFGISWVRQAPGQGLEWMGWISAYSGFTNFAQKFQGRVSMTTDTSTSTVYMELKSLRSDDTAVYYCAREGYSNYEDWFDPWGQGTLVTVSS

SEQ ID NO: 357 - DNA, 363 bp, Homo sapiens
caggttcagctggtgcagtctggacctgagttgaagaagcctggggcctcagtgaaggtctcctgcaaggcttctggttacacctttaccaactttggtatcagctgggtgcgacaggcccctggacaagggcttgagtggatgggctggatcagcgcttacagtggtttcacaaactttgcacagaagttccagggcagagtcagcatgaccacagacacatccacgagcacagtctacatggagctgaagagcctgagatctgacgacacggccgtatattactgtgcgagagagggttacagtaactacgaggactggttcgacccctggggccagggaaccctggtcaccgtctcctca

SEQ ID NO: 358 - protein, 448 aa, Homo sapiens
QVQLVQSGPELKKPGASVKVSCKASGYTFTNFGISWVRQAPGQGLEWMGWISAYSGFTNFAQKFQGRVSMTTDTSTSTVYMELKSLRSDDTAVYYCAREGYSNYEDWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 359 - DNA, 1344 bp, Homo sapiens
caggttcagctggtgcagtctggacctgagttgaagaagcctggggcctcagtgaaggtctcctgcaaggcttctggttacacctttaccaactttggtatcagctgggtgcgacaggcccctggacaagggcttgagtggatgggctggatcagcgcttacagtggtttcacaaactttgcacagaagttccagggcagagtcagcatgaccacagacacatccacgagcacagtctacatggagctgaagagcctgagatctgacgacacggccgtatattactgtgcgagagagggttacagtaactacgaggactggttcgacccctggggccagggaaccctggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 360 - protein, 6 aa, Homo sapiens
ALPKKY

SEQ ID NO: 361 - protein, 3 aa, Homo sapiens
EDS

SEQ ID NO: 362 - protein, 11 aa, Homo sapiens
YSTDSSGNHRV

SEQ ID NO: 363 - protein, 11 aa, Homo sapiens
SGDALPKKYAY

SEQ ID NO: 364 - protein, 7 aa, Homo sapiens
EDSKRPS

SEQ ID NO: 365 - protein, 108 aa, Homo sapiens
SYELTQPPSVSVSPGQTARITCSGDALPKKYAYWYQQKSGQAPVLVIYEDSKRPSGIPERISGSNSGTMATLTISGAQVEDEADYYCYSTDSSGNHRVFGGGTKLTVL

SEQ ID NO: 366 - DNA, 324 bp, Homo sapiens
tcctatgagctgacacagccaccctcggtgtcagtgtccccaggacaaacggccaggatcacctgctctggagatgcattgccaaaaaaatatgcttactggtaccagcagaagtcaggccaggcccctgtgctggtcatctatgaggacagcaaacgaccctccgggatccctgagagaatctctggctccaactcagggacaatggccaccttgactatcagtggggcccaggtggaggatgaagctgactactactgttactcaacagacagcagtggtaatcatagggtattcggcggagggaccaagctgaccgtccta

SEQ ID NO: 367 - protein, 214 aa, Homo sapiens
SYELTQPPSVSVSPGQTARITCSGDALPKKYAYWYQQKSGQAPVLVIYEDSKRPSGIPERISGSNSGTMATLTISGAQVEDEADYYCYSTDSSGNHRVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 368 - DNA, 972 bp, Homo sapiens
tcctatgagctgacacagccaccctcggtgtcagtgtccccaggacaaacggccaggatcacctgctctggagatgcattgccaaaaaaatatgcttactggtaccagcagaagtcaggccaggcccctgtgctggtcatctatgaggacagcaaacgaccctccgggatccctgagagaatctctggctccaactcagggacaatggccaccttgactatcagtggggcccaggtggaggatgaagctgactactactgttactcaacagacagcagtggtaatcatagggtattcggcggagggaccaagctgaccgtcctacagtctgtgttgacgcagccgccctcagtgtctgcggccccaggacagaaggtcaccatctcctgctctggaagcagctccaacattgggaataattatgtatcctggtatcagcagctcccaggaacagcccccaaactcctcatttatgacaataataagcgaccctcggggattcctgaccgattctctggctccaagtctggcacgtcagccaccctgggcatccccgaactccagactggggacgaggccgattattactgcggaacatgggataacagcctgagtgctggggtgttcggcggagggaccaagctgaccgtcctaggacagccaaaagcagccccatccgtaactctgttcccacctagttcagaggagcttcaagcaaacaaagccacacttgtttgccttattagtgatttttatcccggtgccgtgacagttgcctggaaagctgatagctcaccagtgaaagctggcgtggagacaaccacaccatctaaacaaagcaataacaagtatgctgccagctcatatctgagtctcactccagaacaatggaagtctcatcggtcctatagctgtcaagtgacccacgaaggcagtaccgtcgagaagaccgtggcaccaacagagtgtagc

SEQ ID NO: 369 - protein, 8 aa, Homo sapiens
GVTFTNFD

SEQ ID NO: 370 - protein, 8 aa, Homo sapiens
IWYDESYS

SEQ ID NO: 371 - protein, 17 aa, Homo sapiens
VIWYDESYSYYADSVQG

SEQ ID NO: 372 - protein, 119 aa, Homo sapiens
QVQLVESGGGVVQPGRSLRLSCTASGVTFTNFDMHWVRQTPGKGLEWVAVIWYDESYSYYADSVQGRFTISRDNSKNSLYLQMNSLRADDTAVYYCARGWTGSYVFDYWGQGTLVTVSS

SEQ ID NO: 373 - DNA, 357 bp, Homo sapiens
caggtgcagctggtggagtctgggggaggcgtggtccagcctgggaggtccctgagactctcctgtacagcgtctggagtcaccttcactaactttgacatgcactgggtccgccagactccaggcaaggggctggagtgggtggcggttatttggtatgatgaaagttattcatattatgcagactccgtgcagggccgattcaccatctccagagacaattccaagaactccctgtatctgcaaatgaacagcctgagagccgatgacacggctgtgtattactgtgcgagagggtggactgggagctacgtctttgactactggggccagggaaccctggtcaccgtctcctca

SEQ ID NO: 374 - protein, 446 aa, Homo sapiens
QVQLVESGGGVVQPGRSLRLSCTASGVTFTNFDMHWVRQTPGKGLEWVAVIWYDESYSYYADSVQGRFTISRDNSKNSLYLQMNSLRADDTAVYYCARGWTGSYVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 375 - DNA, 1338 bp, Homo sapiens
caggtgcagctggtggagtctgggggaggcgtggtccagcctgggaggtccctgagactctcctgtacagcgtctggagtcaccttcactaactttgacatgcactgggtccgccagactccaggcaaggggctggagtgggtggcggttatttggtatgatgaaagttattcatattatgcagactccgtgcagggccgattcaccatctccagagacaattccaagaactccctgtatctgcaaatgaacagcctgagagccgatgacacggctgtgtattactgtgcgagagggtggactgggagctacgtctttgactactggggccagggaaccctggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 376 - protein, 11 aa, Homo sapiens
AAWDDSLNAVV

SEQ ID NO: 377 - protein, 110 aa, Homo sapiens
QSVLTQPPSVSEAPRQRVTISCSGSSSNIGNNAVNWYQQLPGKAPKLLISYDDLLPSGVSDRFSGSKSGTSASLAISGLQSADEADYYCAAWDDSLNAVVFGGGTKLTVL

SEQ ID NO: 378 - DNA, 330 bp, Homo sapiens
cagtctgtgctgactcagccaccctcggtgtctgaagcccccaggcagagggtcaccatctcctgttctgggagcagctccaacatcggaaataatgctgtaaactggtaccagcagctcccaggaaaggctcccaaactcctcatctcttatgatgatctgctgccctcaggggtctctgaccgattctctggctccaagtctggcacctcagcctccctggccatcagtgggctccagtctgcggatgaggctgattattactgtgcagcatgggatgacagcctgaatgctgtggtatttggcggagggaccaagctgaccgtccta

SEQ ID NO: 379 - protein, 216 aa, Homo sapiens
QSVLTQPPSVSEAPRQRVTISCSGSSSNIGNNAVNWYQQLPGKAPKLLISYDDLLPSGVSDRFSGSKSGTSASLAISGLQSADEADYYCAAWDDSLNAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 380 - DNA, 978 bp, Homo sapiens
cagtctgtgctgactcagccaccctcggtgtctgaagcccccaggcagagggtcaccatctcctgttctgggagcagctccaacatcggaaataatgctgtaaactggtaccagcagctcccaggaaaggctcccaaactcctcatctcttatgatgatctgctgccctcaggggtctctgaccgattctctggctccaagtctggcacctcagcctccctggccatcagtgggctccagtctgcggatgaggctgattattactgtgcagcatgggatgacagcctgaatgctgtggtatttggcggagggaccaagctgaccgtcctacagtctgtgttgacgcagccgccctcagtgtctgcggccccaggacagaaggtcaccatctcctgctctggaagcagctccaacattgggaataattatgtatcctggtatcagcagctcccaggaacagcccccaaactcctcatttatgacaataataagcgaccctcggggattcctgaccgattctctggctccaagtctggcacgtcagccaccctgggcatccccgaactccagactggggacgaggccgattattactgcggaacatgggataacagcctgagtgctggggtgttcggcggagggaccaagctgaccgtcctaggacagccaaaagcagccccatccgtaactctgttcccacctagttcagaggagcttcaagcaaacaaagccacacttgtttgccttattagtgatttttatcccggtgccgtgacagttgcctggaaagctgatagctcaccagtgaaagctggcgtggagacaaccacaccatctaaacaaagcaataacaagtatgctgccagctcatatctgagtctcactccagaacaatggaagtctcatcggtcctatagctgtcaagtgacccacgaaggcagtaccgtcgagaagaccgtggcaccaacagagtgtagc

SEQ ID NO: 381 - protein, 8 aa, Homo sapiens
GFTFSYFG

SEQ ID NO: 382 - protein, 8 aa, Homo sapiens
ISYDGSDE

SEQ ID NO: 383 - protein, 13 aa, Homo sapiens
AKETYQSLMYLEY

SEQ ID NO: 384 - protein, 5 aa, Homo sapiens
YFGMH

SEQ ID NO: 385 - protein, 17 aa, Homo sapiens
DISYDGSDENYADSVKG

SEQ ID NO: 386 - protein, 11 aa, Homo sapiens
ETYQSLMYLEY

SEQ ID NO: 387 - protein, 120 aa, Homo sapiens
QVQLVESGGGVVQPGRSLRLSCAASGFTFSYFGMHWVRQAPGKGLEWVADISYDGSDENYADSVKGRFTISRDNSKNTLSLQMNSLRAEDTAVYYCAKETYQSLMYLEYWGQGILVTVSS

SEQ ID NO: 388 - DNA, 360 bp, Homo sapiens
caggtgcagctggtggagtctgggggaggcgtggtccagcctgggaggtccctgagactctcctgtgcagcctctggattcaccttcagttattttggcatgcactgggtccgccaggctccaggcaaggggctggagtgggtggcagatatatcatatgatggaagtgatgaaaactatgcagactccgtgaagggccgattcaccatctccagagacaattccaagaacacgctgtctctgcaaatgaacagcctgagagctgaggacacggctgtgtattactgtgcgaaagagacgtatcagtcactgatgtatcttgagtactggggccagggaatcctggtcaccgtctcctca

SEQ ID NO: 389 - protein, 447 aa, Homo sapiens
QVQLVESGGGVVQPGRSLRLSCAASGFTFSYFGMHWVRQAPGKGLEWVADISYDGSDENYADSVKGRFTISRDNSKNTLSLQMNSLRAEDTAVYYCAKETYQSLMYLEYWGQGILVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 390 - DNA, 1341 bp, Homo sapiens
caggtgcagctggtggagtctgggggaggcgtggtccagcctgggaggtccctgagactctcctgtgcagcctctggattcaccttcagttattttggcatgcactgggtccgccaggctccaggcaaggggctggagtgggtggcagatatatcatatgatggaagtgatgaaaactatgcagactccgtgaagggccgattcaccatctccagagacaattccaagaacacgctgtctctgcaaatgaacagcctgagagctgaggacacggctgtgtattactgtgcgaaagagacgtatcagtcactgatgtatcttgagtactggggccagggaatcctggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 391 - protein, 6 aa, Homo sapiens
QDIRND

SEQ ID NO: 392 - protein, 3 aa, Homo sapiens
TAP

SEQ ID NO: 393 - protein, 9 aa, Homo sapiens
LQDYNYPWT

SEQ ID NO: 394 - protein, 11 aa, Homo sapiens
RASQDIRNDLG

SEQ ID NO: 395 - protein, 7 aa, Homo sapiens
TAPSLQS

SEQ ID NO: 396 - protein, 107 aa, Homo sapiens
AIQMTQSPSSLSASVGDRVTITCRASQDIRNDLGWYQQKPGKAPKLLIYTAPSLQSGVPSRFSGSGSGTDFTLTIGSLQPEDFATYYCLQDYNYPWTFGQGTKVEIK

SEQ ID NO: 397 - DNA, 321 bp, Homo sapiens
gccatccagatgacccagtctccatcctccctgtctgcatctgttggagacagagtcaccatcacttgccgggcaagtcaggacattagaaatgatttaggctggtatcagcagaaaccagggaaagcccctaagctcctgatctatactgcacccagtttacaaagtggggtcccatcaaggttcagcggcagtggatctggcaccgatttcactctcaccatcggcagcctgcagcctgaagattttgcaacttattactgtctacaagattacaattacccgtggacgttcggccaagggaccaaggtggaaatcaaa

SEQ ID NO: 398 - protein, 214 aa, Homo sapiens
AIQMTQSPSSLSASVGDRVTITCRASQDIRNDLGWYQQKPGKAPKLLIYTAPSLQSGVPSRFSGSGSGTDFTLTIGSLQPEDFATYYCLQDYNYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 399 - DNA, 642 bp, Homo sapiens
gccatccagatgacccagtctccatcctccctgtctgcatctgttggagacagagtcaccatcacttgccgggcaagtcaggacattagaaatgatttaggctggtatcagcagaaaccagggaaagcccctaagctcctgatctatactgcacccagtttacaaagtggggtcccatcaaggttcagcggcagtggatctggcaccgatttcactctcaccatcggcagcctgcagcctgaagattttgcaacttattactgtctacaagattacaattacccgtggacgttcggccaagggaccaaggtggaaatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 400 - protein, 8 aa, Homo sapiens
GYTFNNYG

SEQ ID NO: 401 - protein, 8 aa, Homo sapiens
ISAYSGYT

SEQ ID NO: 402 - protein, 14 aa, Homo sapiens
AREGYSNFEDWFDP

SEQ ID NO: 403 - protein, 5 aa, Homo sapiens
NYGIS

SEQ ID NO: 404 - protein, 17 aa, Homo sapiens
WISAYSGYTNIAQKFQG

SEQ ID NO: 405 - protein, 12 aa, Homo sapiens
EGYSNFEDWFDP

SEQ ID NO: 406 - protein, 121 aa, Homo sapiens
QVQLVQSGAELKKPGASVKVSCKASGYTFNNYGISWVRQAPGQGLEWMGWISAYSGYTNIAQKFQGRVTMTTDTSTNTVYMELGSLRSDDTAVYYCAREGYSNFEDWFDPWGQGTLVTVSS

SEQ ID NO: 407 - DNA, 363 bp, Homo sapiens
caggttcagttggtgcagtctggagctgagttgaagaagcctggggcctcagtgaaggtctcctgcaaggcttctggttacacctttaacaactatggtatcagctgggtgcgacaggcccctggacaagggcttgagtggatgggatggatcagcgcttacagtggttacacaaacattgcacagaagttccagggtagagtcaccatgaccacagacacatccacgaacacagtctacatggaactggggagcctgagatctgacgacacggccgtgtattactgtgcgagagagggctacagtaacttcgaagactggttcgacccctggggccagggaaccctggtcaccgtctcctca

SEQ ID NO: 408 - protein, 448 aa, Homo sapiens
QVQLVQSGAELKKPGASVKVSCKASGYTFNNYGISWVRQAPGQGLEWMGWISAYSGYTNIAQKFQGRVTMTTDTSTNTVYMELGSLRSDDTAVYYCAREGYSNFEDWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 409 - DNA, 1344 bp, Homo sapiens
caggttcagttggtgcagtctggagctgagttgaagaagcctggggcctcagtgaaggtctcctgcaaggcttctggttacacctttaacaactatggtatcagctgggtgcgacaggcccctggacaagggcttgagtggatgggatggatcagcgcttacagtggttacacaaacattgcacagaagttccagggtagagtcaccatgaccacagacacatccacgaacacagtctacatggaactggggagcctgagatctgacgacacggccgtgtattactgtgcgagagagggctacagtaacttcgaagactggttcgacccctggggccagggaaccctggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 410 - protein, 6 aa, Homo sapiens
ELPKKY

SEQ ID NO: 411 - protein, 11 aa, Homo sapiens
SGDELPKKYAY

SEQ ID NO: 412 - protein, 108 aa, Homo sapiens
SYELTQPPSVSVSPGQTARITCSGDELPKKYAYWYQQKSGQAPVLVIYEDSKRPSGIPERISGSNSGTMATLTISGAQVEDEADYYCYSTDSSGNHRVFGGGTKLTVL

SEQ ID NO: 413 - DNA, 324 bp, Homo sapiens
tcctatgagctgacacagcctccctcggtgtcagtgtccccaggacaaacggccaggatcacctgctctggagatgaattgccaaaaaaatatgcttattggtaccagcagaagtcaggccaggcccctgtgctggtcatctatgaggacagcaaacgaccctccgggatccctgagagaatctctggctccaactcagggacaatggccaccttgactatcagtggggcccaggtggaggatgaagctgactactactgttactcaacagacagcagtggtaatcatagggtattcggcggagggaccaagctgaccgtccta

SEQ ID NO: 414 - protein, 214 aa, Homo sapiens
SYELTQPPSVSVSPGQTARITCSGDELPKKYAYWYQQKSGQAPVLVIYEDSKRPSGIPERISGSNSGTMATLTISGAQVEDEADYYCYSTDSSGNHRVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 415 - DNA, 642 bp, Homo sapiens
tcctatgagctgacacagcctccctcggtgtcagtgtccccaggacaaacggccaggatcacctgctctggagatgaattgccaaaaaaatatgcttattggtaccagcagaagtcaggccaggcccctgtgctggtcatctatgaggacagcaaacgaccctccgggatccctgagagaatctctggctccaactcagggacaatggccaccttgactatcagtggggcccaggtggaggatgaagctgactactactgttactcaacagacagcagtggtaatcatagggtattcggcggagggaccaagctgaccgtcctaggacagccaaaagcagccccatccgtaactctgttcccacctagttcagaggagcttcaagcaaacaaagccacacttgtttgccttattagtgatttttatcccggtgccgtgacagttgcctggaaagctgatagctcaccagtgaaagctggcgtggagacaaccacaccatctaaacaaagcaataacaagtatgctgccagctcatatctgagtctcactccagaacaatggaagtctcatcggtcctatagctgtcaagtgacccacgaaggcagtaccgtcgagaagaccgtggcaccaacagagtgtagc

SEQ ID NO: 416 - protein, 8 aa, Homo sapiens
GFILDDYG

SEQ ID NO: 417 - protein, 8 aa, Homo sapiens
ISWNGDST

SEQ ID NO: 418 - protein, 17 aa, Homo sapiens
AREYSGDFYYYYYGMDV

SEQ ID NO: 419 - protein, 5 aa, Homo sapiens
DYGMN

SEQ ID NO: 420 - protein, 17 aa, Homo sapiens
GISWNGDSTRYADSVKG

SEQ ID NO: 421 - protein, 15 aa, Homo sapiens
EYSGDFYYYYYGMDV

SEQ ID NO: 422 - protein, 124 aa, Homo sapiens
EVQLVESGGAVVRPGGSLRLSCAISGFILDDYGMNWVRQGPGKGLEWVAGISWNGDSTRYADSVKGRFTISRDNAQNSLYLQMNSLRAEDTALYFCAREYSGDFYYYYYGMDVWGQGTTVTVSS

SEQ ID NO: 423 - DNA, 371 bp, Homo sapiens
gaggtgcagctggtggagtctgggggagctgtggtacggcctggggggtccctgaggctctcctgtgcaatttctggattcatcttggatgactatggcatgaactgggtccgccaaggtccagggaaggggctggagtgggtcgctggtattagttggaatggtgatagcacacgttatgcagactctgtgaagggccgattcaccatctccagagacaacgcccagaactccctgtatctgcaaatgaaagtctgagagccgaggacacggccttgtatttctgtgcgagagaatatagtggagacttctactattactactacggtatggacgtctggggccaagggaccacggtcaccgtctcctca

SEQ ID NO: 424 - protein, 451 aa, Homo sapiens
EVQLVESGGAVVRPGGSLRLSCAISGFILDDYGMNWVRQGPGKGLEWVAGISWNGDSTRYADSVKGRFTISRDNAQNSLYLQMNSLRAEDTALYFCAREYSGDFYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 425 - DNA, 1352 bp, Homo sapiens
gaggtgcagctggtggagtctgggggagctgtggtacggcctggggggtccctgaggctctcctgtgcaatttctggattcatcttggatgactatggcatgaactgggtccgccaaggtccagggaaggggctggagtgggtcgctggtattagttggaatggtgatagcacacgttatgcagactctgtgaagggccgattcaccatctccagagacaacgcccagaactccctgtatctgcaaatgaaagtctgagagccgaggacacggccttgtatttctgtgcgagagaatatagtggagacttctactattactactacggtatggacgtctggggccaagggaccacggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 426 - protein, 10 aa, Homo sapiens
SSYAGSNNLV

SEQ ID NO: 427 - protein, 110 aa, Homo sapiens
QSALTQPPSASGSPGQSVTISCTGTSSDVGFYNFVSWYQHHPGKAPKLMIYEVSKRPSGVPDRFSGSKSANTASLTVSGLQAEDEADYYCSSYAGSNNLVFGGGTKLTVL

SEQ ID NO: 428 - DNA, 330 bp, Homo sapiens
cagtctgccctgactcagcctccctccgcgtccgggtctcctggacagtcagtcaccatctcctgcactggaaccagcagtgacgttggtttttataactttgtctcctggtaccaacatcacccaggcaaagcccccaaactcatgatttatgaggtcagtaagcggccctcaggggtccctgatcgcttctctggctccaagtctgccaacacggcctccctgaccgtctctgggctccaggctgaggatgaggctgattattactgcagttcatatgcaggcagcaacaatttggtgttcggcggagggaccaagctgaccgtccta

SEQ ID NO: 429 - protein, 216 aa, Homo sapiens
QSALTQPPSASGSPGQSVTISCTGTSSDVGFYNFVSWYQHHPGKAPKLMIYEVSKRPSGVPDRFSGSKSANTASLTVSGLQAEDEADYYCSSYAGSNNLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 430 - DNA, 648 bp, Homo sapiens
cagtctgccctgactcagcctccctccgcgtccgggtctcctggacagtcagtcaccatctcctgcactggaaccagcagtgacgttggtttttataactttgtctcctggtaccaacatcacccaggcaaagcccccaaactcatgatttatgaggtcagtaagcggccctcaggggtccctgatcgcttctctggctccaagtctgccaacacggcctccctgaccgtctctgggctccaggctgaggatgaggctgattattactgcagttcatatgcaggcagcaacaatttggtgttcggcggagggaccaagctgaccgtcctaggacagccaaaagcagccccatccgtaactctgttcccacctagttcagaggagcttcaagcaaacaaagccacacttgtttgccttattagtgatttttatcccggtgccgtgacagttgcctggaaagctgatagctcaccagtgaaagctggcgtggagacaaccacaccatctaaacaaagcaataacaagtatgctgccagctcatatctgagtctcactccagaacaatggaagtctcatcggtcctatagctgtcaagtgacccacgaaggcagtaccgtcgagaagaccgtggcaccaacagagtgtagc

SEQ ID NO: 431 - protein, 8 aa, Homo sapiens
GFTFGDYV

SEQ ID NO: 432 - protein, 10 aa, Homo sapiens
IRSKPYSETT

SEQ ID NO: 433 - protein, 23 aa, Homo sapiens
TRALYDLLTGPWMGGDYFYALDV

SEQ ID NO: 434 - protein, 5 aa, Homo sapiens
DYVMS

SEQ ID NO: 435 - protein, 19 aa, Homo sapiens
FIRSKPYSETTEYAASVRG

SEQ ID NO: 436 - protein, 21 aa, Homo sapiens
ALYDLLTGPWMGGDYFYALDV

SEQ ID NO: 437 - protein, 132 aa, Homo sapiens
EVQLVESGGGLVKPGRSLRLSCTASGFTFGDYVMSWFRQAPGKGLEWVGFIRSKPYSETTEYAASVRGRFTISRDDSKSIAYLQMNSLKTEDTAVYYCTRALYDLLTGPWMGGDYFYALDVWGQGTTVTVSS

SEQ ID NO: 438 - DNA, 396 bp, Homo sapiens
gaggttcaactggtggagtctgggggaggcttggtaaagccagggcggtccctgagactctcctgtacagcttctggattcacctttggtgattatgttatgagctggttccgccaggctccagggaagggactggagtgggtaggtttcattagaagcaaaccttatagtgagacaacagaatacgccgcgtctgtgagaggcagattcaccatctcaagagatgattccaaaagcatcgcctatctgcaaatgaacagcctgaaaaccgaggacacagccgtgtattactgtactagagccctttacgatcttttgactggtccatggatgggaggggactacttctacgctttggacgtctggggccaagggaccacggtcaccgtctcctca

SEQ ID NO: 439 - protein, 459 aa, Homo sapiens
EVQLVESGGGLVKPGRSLRLSCTASGFTFGDYVMSWFRQAPGKGLEWVGFIRSKPYSETTEYAASVRGRFTISRDDSKSIAYLQMNSLKTEDTAVYYCTRALYDLLTGPWMGGDYFYALDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 440 - DNA, 1377 bp, Homo sapiens
gaggttcaactggtggagtctgggggaggcttggtaaagccagggcggtccctgagactctcctgtacagcttctggattcacctttggtgattatgttatgagctggttccgccaggctccagggaagggactggagtgggtaggtttcattagaagcaaaccttatagtgagacaacagaatacgccgcgtctgtgagaggcagattcaccatctcaagagatgattccaaaagcatcgcctatctgcaaatgaacagcctgaaaaccgaggacacagccgtgtattactgtactagagccctttacgatcttttgactggtccatggatgggaggggactacttctacgctttggacgtctggggccaagggaccacggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 441 - protein, 9 aa, Homo sapiens
SSDVGDYNY

SEQ ID NO: 442 - protein, 10 aa, Homo sapiens
KSYAGSNNLV

SEQ ID NO: 443 - protein, 14 aa, Homo sapiens
TGTSSDVGDYNYVS

SEQ ID NO: 444 - protein, 110 aa, Homo sapiens
QSALTQPPSASGSPGQSVTISCTGTSSDVGDYNYVSWYQQHPGKAPKLMIYEVSKRPSGVPDRFSGSKSGNTASLTVSGLQAEDEADYYCKSYAGSNNLVFGGGTKLTVL

SEQ ID NO: 445 - DNA, 330 bp, Homo sapiens
cagtctgccctgactcagcctccctccgcgtccgggtctcctggacagtcagtcaccatctcctgcactggaaccagcagtgacgttggtgattataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcaagtcatatgcaggcagcaacaatttggtgttcggcggagggaccaaactgaccgtccta

SEQ ID NO: 446 - protein, 216 aa, Homo sapiens
QSALTQPPSASGSPGQSVTISCTGTSSDVGDYNYVSWYQQHPGKAPKLMIYEVSKRPSGVPDRFSGSKSGNTASLTVSGLQAEDEADYYCKSYAGSNNLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 447 - DNA, 648 bp, Homo sapiens
cagtctgccctgactcagcctccctccgcgtccgggtctcctggacagtcagtcaccatctcctgcactggaaccagcagtgacgttggtgattataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcaagtcatatgcaggcagcaacaatttggtgttcggcggagggaccaaactgaccgtcctaggacagccaaaagcagccccatccgtaactctgttcccacctagttcagaggagcttcaagcaaacaaagccacacttgtttgccttattagtgatttttatcccggtgccgtgacagttgcctggaaagctgatagctcaccagtgaaagctggcgtggagacaaccacaccatctaaacaaagcaataacaagtatgctgccagctcatatctgagtctcactccagaacaatggaagtctcatcggtcctatagctgtcaagtgacccacgaaggcagtaccgtcgagaagaccgtggcaccaacagagtgtagc

SEQ ID NO: 448 - protein, 8 aa, Homo sapiens
ISYDGSKK

SEQ ID NO: 449 - protein, 13 aa, Homo sapiens
AKEGYGGYDGFDY

SEQ ID NO: 450 - protein, 5 aa, Homo sapiens
NFDMD

SEQ ID NO: 451 - protein, 17 aa, Homo sapiens
LISYDGSKKYYADSVKG

SEQ ID NO: 452 - protein, 11 aa, Homo sapiens
EGYGGYDGFDY

SEQ ID NO: 453 - protein, 120 aa, Homo sapiens
QVQLVESGGGVVQPGRSLRLSCAASGFTFSNFDMDWVRQAPGRGLEWVALISYDGSKKYYADSVKGRFTISRDNSKNTLYLQMNSLRGEDTAVYFCAKEGYGGYDGFDYWGQGTLVTVSS

SEQ ID NO: 454 - DNA, 360 bp, Homo sapiens
caggtgcagctggtggagtctgggggaggcgtggtccagcctgggaggtccctgagactctcctgtgcagcctctggattcaccttcagtaactttgacatggactgggtccgccaggctccaggcagggggctggagtgggtggcacttatatcatatgatggaagtaaaaaatactatgcagactccgtgaagggccgattcaccatctccagagacaattccaagaacacgctgtatctgcaaatgaacagtctgagaggtgaggacacggctgtatatttctgtgcgaaagagggatatggtggctacgatggatttgactactggggccagggaaccctggtcaccgtctcctca

SEQ ID NO: 455 - protein, 447 aa, Homo sapiens
QVQLVESGGGVVQPGRSLRLSCAASGFTFSNFDMDWVRQAPGRGLEWVALISYDGSKKYYADSVKGRFTISRDNSKNTLYLQMNSLRGEDTAVYFCAKEGYGGYDGFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 456 - DNA, 1341 bp, Homo sapiens
caggtgcagctggtggagtctgggggaggcgtggtccagcctgggaggtccctgagactctcctgtgcagcctctggattcaccttcagtaactttgacatggactgggtccgccaggctccaggcagggggctggagtgggtggcacttatatcatatgatggaagtaaaaaatactatgcagactccgtgaagggccgattcaccatctccagagacaattccaagaacacgctgtatctgcaaatgaacagtctgagaggtgaggacacggctgtatatttctgtgcgaaagagggatatggtggctacgatggatttgactactggggccagggaaccctggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 457 - protein, 8 aa, Homo sapiens
TSNIGNNA

SEQ ID NO: 458 - protein, 3 aa, Homo sapiens
YDY

SEQ ID NO: 459 - protein, 11 aa, Homo sapiens
STWDDGLNGVV

SEQ ID NO: 460 - protein, 13 aa, Homo sapiens
SGSTSNIGNNAVN

SEQ ID NO: 461 - protein, 7 aa, Homo sapiens
YDYVVSS

SEQ ID NO: 462 - protein, 110 aa, Homo sapiens
QSVLTQPPSVSEAPRQRVTISCSGSTSNIGNNAVNWYQQLPGKAPKLLISYDYVVSSGVSDRFSGSKSGTSASLAISGLQSADEADYYCSTWDDGLNGVVFGGGTKLTVL

SEQ ID NO: 463 - DNA, 330 bp, Homo sapiens
cagtctgtgctgactcagccaccctcggtatctgaagcccccaggcagagggtcaccatctcctgttctggaagcacctccaacatcggcaataatgctgtaaactggtaccagcagctcccaggaaaggctcccaaactcctcatctcttatgattatgtggtgtcctcaggggtctctgaccgcttctcaggctccaagtctggcacctcagcctccctggccatcagtgggctccagtctgcggatgaggctgattattactgttcaacatgggatgacggcctgaatggtgtggtattcggcggagggaccaagctgaccgtccta

SEQ ID NO: 464 - protein, 216 aa, Homo sapiens
QSVLTQPPSVSEAPRQRVTISCSGSTSNIGNNAVNWYQQLPGKAPKLLISYDYVVSSGVSDRFSGSKSGTSASLAISGLQSADEADYYCSTWDDGLNGVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 465 - DNA, 648 bp, Homo sapiens
cagtctgtgctgactcagccaccctcggtatctgaagcccccaggcagagggtcaccatctcctgttctggaagcacctccaacatcggcaataatgctgtaaactggtaccagcagctcccaggaaaggctcccaaactcctcatctcttatgattatgtggtgtcctcaggggtctctgaccgcttctcaggctccaagtctggcacctcagcctccctggccatcagtgggctccagtctgcggatgaggctgattattactgttcaacatgggatgacggcctgaatggtgtggtattcggcggagggaccaagctgaccgtcctaggacagccaaaagcagccccatccgtaactctgttcccacctagttcagaggagcttcaagcaaacaaagccacacttgtttgccttattagtgatttttatcccggtgccgtgacagttgcctggaaagctgatagctcaccagtgaaagctggcgtggagacaaccacaccatctaaacaaagcaataacaagtatgctgccagctcatatctgagtctcactccagaacaatggaagtctcatcggtcctatagctgtcaagtgacccacgaaggcagtaccgtcgagaagaccgtggcaccaacagagtgtagc

SEQ ID NO: 466 - protein, 10 aa, Homo sapiens
GGAISSSNYF

SEQ ID NO: 467 - protein, 7 aa, Homo sapiens
MYYTGIT

SEQ ID NO: 468 - protein, 13 aa, Homo sapiens
ARQDGFRTGWFDP

SEQ ID NO: 469 - protein, 7 aa, Homo sapiens
SSNYFWG

SEQ ID NO: 470 - protein, 16 aa, Homo sapiens
SMYYTGITYYNPSLKS

SEQ ID NO: 471 - protein, 11 aa, Homo sapiens
QDGFRTGWFDP

SEQ ID NO: 472 - protein, 121 aa, Homo sapiens
QLQLQESGPGLVKPSETLSLTCTVSGGAISSSNYFWGWIRQSPGKGLEWIGSMYYTGITYYNPSLKSRVTISVDTSKNQLSLKVNSVTAADTAVYYCARQDGFRTGWFDPWGQGTLVTVSS

SEQ ID NO: 473 - DNA, 363 bp, Homo sapiens
cagctgcagcttcaggagtcgggcccaggactggtgaagccttcggagaccctgtccctcacctgcactgtctctggtggcgccatcagcagtagtaattacttttggggctggatccgccagtccccagggaaggggctggagtggattgggagtatgtattatactgggatcacctactacaacccgtccctcaagagtcgagtcaccatatccgtagacacgtccaagaaccaactctccctgaaggtgaattctgtgaccgccgcagacacggctgtttactactgtgcgagacaagatggattcagaacggggtggttcgacccctggggccagggaaccctggtcaccgtctcctca

SEQ ID NO: 474 - protein, 448 aa, Homo sapiens
QLQLQESGPGLVKPSETLSLTCTVSGGAISSSNYFWGWIRQSPGKGLEWIGSMYYTGITYYNPSLKSRVTISVDTSKNQLSLKVNSVTAADTAVYYCARQDGFRTGWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 475 - DNA, 1344 bp, Homo sapiens
cagctgcagcttcaggagtcgggcccaggactggtgaagccttcggagaccctgtccctcacctgcactgtctctggtggcgccatcagcagtagtaattacttttggggctggatccgccagtccccagggaaggggctggagtggattgggagtatgtattatactgggatcacctactacaacccgtccctcaagagtcgagtcaccatatccgtagacacgtccaagaaccaactctccctgaaggtgaattctgtgaccgccgcagacacggctgtttactactgtgcgagacaagatggattcagaacggggtggttcgacccctggggccagggaaccctggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 476 - protein, 6 aa, Homo sapiens
KLGDNY

SEQ ID NO: 477 - protein, 3 aa, Homo sapiens
QDT

SEQ ID NO: 478 - protein, 9 aa, Homo sapiens
QAWDSRTVV

SEQ ID NO: 479 - protein, 11 aa, Homo sapiens
SGDKLGDNYVC

SEQ ID NO: 480 - protein, 7 aa, Homo sapiens
QDTKRPS

SEQ ID NO: 481 - protein, 106 aa, Homo sapiens
SYELTQPPSVSVSPGQTATLTCSGDKLGDNYVCWFQQKPGQSPLLVMYQDTKRPSGIPERFSGSNSGNTATLTISGTQALDEADYYCQAWDSRTVVFGGGTKLTVL

SEQ ID NO: 482 - DNA, 318 bp, Homo sapiens
tcctatgaactgactcagccaccctccgtgtccgtgtccccaggacagacagccaccctcacctgctctggagataaattgggggataactatgtttgctggtttcagcaaaagccaggccagtcccctctgttggtcatgtatcaagataccaagcggccctcagggatccctgagcgattctcgggctccaactctgggaacacagccactctgaccatcagcgggacccaggctttggatgaggctgactattactgtcaggcgtgggacagccgcactgtggttttcggcggagggaccaagctgaccgtccta

SEQ ID NO: 483 - protein, 212 aa, Homo sapiens
SYELTQPPSVSVSPGQTATLTCSGDKLGDNYVCWFQQKPGQSPLLVMYQDTKRPSGIPERFSGSNSGNTATLTISGTQALDEADYYCQAWDSRTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 484 - DNA, 636 bp, Homo sapiens
tcctatgaactgactcagccaccctccgtgtccgtgtccccaggacagacagccaccctcacctgctctggagataaattgggggataactatgtttgctggtttcagcaaaagccaggccagtcccctctgttggtcatgtatcaagataccaagcggccctcagggatccctgagcgattctcgggctccaactctgggaacacagccactctgaccatcagcgggacccaggctttggatgaggctgactattactgtcaggcgtgggacagccgcactgtggttttcggcggagggaccaagctgaccgtcctaggacagccaaaagcagccccatccgtaactctgttcccacctagttcagaggagcttcaagcaaacaaagccacacttgtttgccttattagtgatttttatcccggtgccgtgacagttgcctggaaagctgatagctcaccagtgaaagctggcgtggagacaaccacaccatctaaacaaagcaataacaagtatgctgccagctcatatctgagtctcactccagaacaatggaagtctcatcggtcctatagctgtcaagtgacccacgaaggcagtaccgtcgagaagaccgtggcaccaacagagtgtagc

SEQ ID NO: 485 - protein, 8 aa, Homo sapiens
GYTFSSFG

SEQ ID NO: 486 - protein, 8 aa, Homo sapiens
ISAYNGIS

SEQ ID NO: 487 - protein, 12 aa, Homo sapiens
ARDRANRDALDV

SEQ ID NO: 488 - protein, 5 aa, Homo sapiens
SFGIT

SEQ ID NO: 489 - protein, 17 aa, Homo sapiens
WISAYNGISNSAQKVQG

SEQ ID NO: 490 - protein, 10 aa, Homo sapiens
DRANRDALDV

SEQ ID NO: 491 - protein, 119 aa, Homo sapiens
QVQLVQSGAEVRKPGAAVKVSCKASGYTFSSFGITWIRQAPGQGLEWMGWISAYNGISNSAQKVQGRVTMTTDTSTSTAYMELRSLRSDDSAVYYCARDRANRDALDVWGQGTKVTVSL

SEQ ID NO: 492 - DNA, 357 bp, Homo sapiens
caggttcaactggtgcaatctggagctgaggtgaggaagcctggggccgcagtgaaggtctcctgcaaggcttctggttacaccttttccagctttggtatcacctggatacgacaggcccctggacaagggcttgagtggatgggatggatcagcgcttacaatggtatctcaaactctgcacagaaggtccagggcagagtcaccatgaccacagacacatccacgagcacagcctacatggaactgaggagcctgagatctgacgactcggccgtatattactgtgcgagagatcgggcgaatagggatgctcttgatgtctggggccaagggacaaaggtcaccgtctcttta

SEQ ID NO: 493 - protein, 446 aa, Homo sapiens
QVQLVQSGAEVRKPGAAVKVSCKASGYTFSSFGITWIRQAPGQGLEWMGWISAYNGISNSAQKVQGRVTMTTDTSTSTAYMELRSLRSDDSAVYYCARDRANRDALDVWGQGTKVTVSLASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 494 - DNA, 1338 bp, Homo sapiens
caggttcaactggtgcaatctggagctgaggtgaggaagcctggggccgcagtgaaggtctcctgcaaggcttctggttacaccttttccagctttggtatcacctggatacgacaggcccctggacaagggcttgagtggatgggatggatcagcgcttacaatggtatctcaaactctgcacagaaggtccagggcagagtcaccatgaccacagacacatccacgagcacagcctacatggaactgaggagcctgagatctgacgactcggccgtatattactgtgcgagagatcgggcgaatagggatgctcttgatgtctggggccaagggacaaaggtcaccgtctctttagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 495 - protein, 6 aa, Homo sapiens
ELGDRY

SEQ ID NO: 496 - protein, 11 aa, Homo sapiens
SGDELGDRYAC

SEQ ID NO: 497 - protein, 106 aa, Homo sapiens
SHELTQPPSMSVSPGQTASITCSGDELGDRYACWYQQKPGQSPVLVIYQDTKRPSGIPERFSGSISGNTATLTISGTQAMDEADYYCQAWDSSTVVFGGGTKLTVL

SEQ ID NO: 498 - DNA, 318 bp, Homo sapiens
tcccatgaactgactcagccaccctcaatgtccgtgtccccaggacagactgccagcatcacctgctctggagatgaattgggggatagatatgcttgctggtatcaacagaagccaggccagtcccctgtactggtcatctatcaagataccaagcggccctcagggatccctgagcgattctctggctccatctctgggaacacagccactctgaccatcagcgggacccaggctatggatgaggctgactattactgtcaggcgtgggacagcagcactgtggtattcggcggagggaccaagttgaccgtccta

SEQ ID NO: 499 - protein, 212 aa, Homo sapiens
SHELTQPPSMSVSPGQTASITCSGDELGDRYACWYQQKPGQSPVLVIYQDTKRPSGIPERFSGSISGNTATLTISGTQAMDEADYYCQAWDSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 500 - DNA, 636 bp, Homo sapiens
tcccatgaactgactcagccaccctcaatgtccgtgtccccaggacagactgccagcatcacctgctctggagatgaattgggggatagatatgcttgctggtatcaacagaagccaggccagtcccctgtactggtcatctatcaagataccaagcggccctcagggatccctgagcgattctctggctccatctctgggaacacagccactctgaccatcagcgggacccaggctatggatgaggctgactattactgtcaggcgtgggacagcagcactgtggtattcggcggagggaccaagttgaccgtcctaggacagccaaaagcagccccatccgtaactctgttcccacctagttcagaggagcttcaagcaaacaaagccacacttgtttgccttattagtgatttttatcccggtgccgtgacagttgcctggaaagctgatagctcaccagtgaaagctggcgtggagacaaccacaccatctaaacaaagcaataacaagtatgctgccagctcatatctgagtctcactccagaacaatggaagtctcatcggtcctatagctgtcaagtgacccacgaaggcagtaccgtcgagaagaccgtggcaccaacagagtgtagc

SEQ ID NO: 501 - protein, 10 aa, Homo sapiens
GDSISSHTYW

SEQ ID NO: 502 - protein, 7 aa, Homo sapiens
MFYSGST

SEQ ID NO: 503 - protein, 14 aa, Homo sapiens
ARHNNWGMENYFDD

SEQ ID NO: 504 - protein, 7 aa, Homo sapiens
SHTYWWG

SEQ ID NO: 505 - protein, 16 aa, Homo sapiens
SMFYSGSTYYNPSLKS

SEQ ID NO: 506 - protein, 12 aa, Homo sapiens
HNNWGMENYFDD

SEQ ID NO: 507 - protein, 122 aa, Homo sapiens
QLQLQESGPGLVKPSETLSLTCTVSGDSISSHTYWWGWIRQPPGKGLEWIGSMFYSGSTYYNPSLKSRVVISVDTSRNQFSLKVRSVTAADTAVFYCARHNNWGMENYFDDWGQGTLVTVSS

SEQ ID NO: 508 - DNA, 366 bp, Homo sapiens
cagctgcagctgcaggagtcgggcccaggactggtgaagccttcggagaccctgtccctcacctgcactgtctctggtgactccatcagtagtcatacttactggtggggctggatccgccagcccccagggaaggggctggagtggattgggagtatgttttatagtgggagcacctactacaatccgtccctcaagagtcgagtcgtcatatccgtagacacgtccaggaaccagttctccctgaaagtgaggtctgtgaccgccgcagacacggctgtgttttactgtgcgagacataataattggggaatggagaactactttgacgactggggccagggaaccctggtcaccgtctcctca

SEQ ID NO: 509 - protein, 449 aa, Homo sapiens
QLQLQESGPGLVKPSETLSLTCTVSGDSISSHTYWWGWIRQPPGKGLEWIGSMFYSGSTYYNPSLKSRVVISVDTSRNQFSLKVRSVTAADTAVFYCARHNNWGMENYFDDWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 510 - DNA, 1347 bp, Homo sapiens
cagctgcagctgcaggagtcgggcccaggactggtgaagccttcggagaccctgtccctcacctgcactgtctctggtgactccatcagtagtcatacttactggtggggctggatccgccagcccccagggaaggggctggagtggattgggagtatgttttatagtgggagcacctactacaatccgtccctcaagagtcgagtcgtcatatccgtagacacgtccaggaaccagttctccctgaaagtgaggtctgtgaccgccgcagacacggctgtgttttactgtgcgagacataataattggggaatggagaactactttgacgactggggccagggaaccctggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 511 - protein, 11 aa, Homo sapiens
QSADSSGSYVV

SEQ ID NO: 512 - protein, 11 aa, Homo sapiens
SADALPDQYGY

SEQ ID NO: 513 - protein, 108 aa, Homo sapiens
SYALTQPPSVSVSPGQTARITCSADALPDQYGYWYQQKPGQAPVLVIYKDSERPSGIPERFSGSSSGTTVTLTISGVQAEDEADYYCQSADSSGSYVVFGGGTKLTVL

SEQ ID NO: 514 - DNA, 324 bp, Homo sapiens
tcctatgcgctgacacagccaccctcggtgtcagtgtccccaggacagacggccaggatcacctgctctgcagatgcattgccagaccaatatggttactggtaccagcagaagccaggccaggcccctgtgctggtgatatataaagacagtgagaggccctcagggatccctgagcggttctctggctccagctcagggacaacagtcacgttgaccatcagtggagtccaggcagaagacgaggctgactattactgtcaatcagcagacagcagtggttcttatgtggtattcggcggagggaccaagctgaccgtccta

SEQ ID NO: 515 - protein, 214 aa, Homo sapiens
SYALTQPPSVSVSPGQTARITCSADALPDQYGYWYQQKPGQAPVLVIYKDSERPSGIPERFSGSSSGTTVTLTISGVQAEDEADYYCQSADSSGSYVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 516 - DNA, 642 bp, Homo sapiens
tcctatgcgctgacacagccaccctcggtgtcagtgtccccaggacagacggccaggatcacctgctctgcagatgcattgccagaccaatatggttactggtaccagcagaagccaggccaggcccctgtgctggtgatatataaagacagtgagaggccctcagggatccctgagcggttctctggctccagctcagggacaacagtcacgttgaccatcagtggagtccaggcagaagacgaggctgactattactgtcaatcagcagacagcagtggttcttatgtggtattcggcggagggaccaagctgaccgtcctaggacagccaaaagcagccccatccgtaactctgttcccacctagttcagaggagcttcaagcaaacaaagccacacttgtttgccttattagtgatttttatcccggtgccgtgacagttgcctggaaagctgatagctcaccagtgaaagctggcgtggagacaaccacaccatctaaacaaagcaataacaagtatgctgccagctcatatctgagtctcactccagaacaatggaagtctcatcggtcctatagctgtcaagtgacccacgaaggcagtaccgtcgagaagaccgtggcaccaacagagtgtagc

SEQ ID NO: 517 - DNA, 990 bp, Homo sapiens
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 518 - protein, 330 aa, Homo sapiens [sequence omitted]

SEQ ID NO: 519 - DNA, 990 bp, Homo sapiens
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 520 - protein, 330 aa, Homo sapiens [sequence omitted]

SEQ ID NO: 521 - DNA, 990 bp, Homo sapiens
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaa

SEQ ID NO: 522 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 523 - DNA, 990 bp, Homo sapiens
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacatcttctcatgctccgtgatgcatgaggctctgcacaaccactacacgcagaagagcctctccctgtctccgggtaaa

SEQ ID NO: 524 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNIFSCSVMHEALHNHYTQKSLSLSPGK

SEQ ID NO: 525 - DNA, 990 bp, Homo sapiens
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagtggagcccaaatcttgtgacaaaactcacacatgcccaccgtgcccagcacctgaactcgcgggggcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 526 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 527 - DNA, 978 bp, Homo sapiens
gcctccaccaagggcccatcggtcttccccctggcgccctgctccaggagcacctccgagagcacagccgccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 528 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 529 - DNA, 978 bp, Homo sapiens
gcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgacctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcatggaggtgcataatgccaagacaaagccacgggaggagcagttcaacagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaa

SEQ ID NO: 530 - protein, 326 aa, Homo sapiens
ASTKGPSVFPLAPCSRSTSESTAALGCLVKDYFPEPVTVSWNSGALTSGVHTFPAVLQSSGLYSLSSVVTVTSSNFGTQTYTCNVDHKPSNTKVDKTVERKCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 531 - DNA, 978 bp, Homo sapiens
gcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcagcttgggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 532 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 533 - DNA, 978 bp, Homo sapiens
gcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatctccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaa

SEQ ID NO: 534 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 535 - DNA, 981 bp, Homo sapiens
gcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaa

SEQ ID NO: 536 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 537 - DNA, 981 bp, Homo sapiens
gcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccgtgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcgtgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacgcagaagagcctctccctgtctctgggtaaa

SEQ ID NO: 538 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVVHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 539 - DNA, 981 bp, Homo sapiens
gcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaagctcaccgtggacaagagcaggtggcaggaggggaacgtcttctcatgctccgtgatgcatgaggctctgcacaaccactacacgcagaagagcctctccctgtctctgggtaaa

SEQ ID NO: 540 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 541 - DNA, 981 bp, Homo sapiens
gcctccaccaagggcccatccgtcttccccctggcgccctgctccaggagcacctccgagagcacggccgccctgggctgcctggtcaaggactacttccccgaaccagtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcgcctgaatttgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcatcgatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggatccttcttcctctacagcaggctaaccgtggacaagagcaggtggcaggaggggaatgtcttctcatgctccgtgatgcatgaggctctgcacaaccactacacacagaagagcctctccctgtctctgggtaaa

SEQ ID NO: 542 - DNA, 981 bp, Homo sapiens
gcctccaccaagggacctagcgtgttccctctcgccccctgttccaggtccacaagcgagtccaccgctgccctcggctgtctggtgaaagactactttcccgagcccgtgaccgtctcctggaatagcggagccctgacctccggcgtgcacacatttcccgccgtgctgcagagcagcggactgtatagcctgagcagcgtggtgaccgtgcccagctccagcctcggcaccaaaacctacacctgcaacgtggaccacaagccctccaacaccaaggtggacaagcgggtggagagcaagtacggccccccttgccctccttgtcctgcccctgagttcgagggaggaccctccgtgttcctgtttccccccaaacccaaggacaccctgatgatctcccggacacccgaggtgacctgtgtggtcgtggacgtcagccaggaggaccccgaggtgcagttcaactggtatgtggacggcgtggaggtgcacaatgccaaaaccaagcccagggaggagcagttcaattccacctacagggtggtgagcgtgctgaccgtcctgcatcaggattggctgaacggcaaggagtacaagtgcaaggtgtccaacaagggactgcccagctccatcgagaagaccatcagcaaggctaagggccagccgagggagccccaggtgtataccctgcctcctagccaggaagagatgaccaagaaccaagtgtccctgacctgcctggtgaagggattctacccctccgacatcgccgtggagtgggagagcaatggccagcccgagaacaactacaaaacaacccctcccgtgctcgatagcgacggcagcttctttctctacagccggctgacagtggacaagagcaggtggcaggagggcaacgtgttctcctgttccgtgatgcacgaggccctgcacaatcactacacccagaagagcctctccctgtccctgggcaag

SEQ ID NO: 543 - DNA, 981 bp, Homo sapiens
gccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 544 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 545 - DNA, 981 bp, Homo sapiens
gcctccaccaagggcccatccgtcttccccctggcgccctgctccaggagcacctccgagagcacggccgccctgggctgcctggtcaaggactacttccccgaaccagtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcgcctccagttgcggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcatcgatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggatccttcttcctctacagcaggctaaccgtggacaagagcaggtggcaggaggggaatgtcttctcatgctccgtgatgcatgaggctctgcacaaccactacacacagaagagcctctccctgtctctgggtaaa

SEQ ID NO: 546 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPPVAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 547 - DNA, 321 bp, Homo sapiens
cgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 548 - protein, 107 aa, Homo sapiens [sequence omitted]

SEQ ID NO: 549 - DNA, 321 bp, Homo sapiens
cgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggagagcaaggacagcacctacagcctcagcagcaccctgacgctgagcaaagcagactacgagaaacacaaagtctacgccggcgaagtcacccatcagggcctgagctcgcccgtcacaaagagcttcaacaggggagagtgt

SEQ ID NO: 550 - protein, 107 aa, Homo sapiens
RTVAAPSVFIFPPSDEQLKSGTASVVCLLNNFYPREAKVQWKVDNALQSGNSQESVTEQESKDSTYSLSSTLTLSKADYEKHKVYAGEVTHQGLSSPVTKSFNRGEC

SEQ ID NO: 551 - DNA, 321 bp, Homo sapiens
cgaactgtggctgcaccatctgtcttcatcttcccgccatctgatgagcagttgaaatctggaactgcctctgttgtgtgcctgctgaataacttctatcccagagaggccaaagtacagcggaaggtggataacgccctccaatcgggtaactcccaggagagtgtcacagagcaggagagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 552 - protein, 107 aa, Homo sapiens
RTVAAPSVFIFPPSDEQLKSGTASVVCLLNNFYPREAKVQRKVDNALQSGNSQESVTEQESKDSTYSLSSTLTLSKADYEKHKVYACEVTHQGLSSPVTKSFNRGEC

SEQ ID NO: 553 - DNA, 321 bp, Homo sapiens
cgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaactctacgcctgcgaagtcacccatcagggcctgagctcgcccgtcacaaagagcttcaacaggggagagtgt

SEQ ID NO: 554 - protein, 107 aa, Homo sapiens
RTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 555 - DNA, 321 bp, Homo sapiens
cgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcaacaccctgacgctgagcaaagcagactacgagaaacacaaagtctacgcctgcgaagtcacccatcagggcctgagctcgcccgtcacaaagagcttcaacaggggagagtgc

SEQ ID NO: 556 - protein, 107 aa, Homo sapiens
RTVAAPSVFIFPPSDEQLKSGTASVVCLLNNFYPREAKVQWKVDNALQSGNSQESVTEQDSKDSTYSLSNTLTLSKADYEKHKVYACEVTHQGLSSPVTKSFNRGEC

SEQ ID NO: 557 - DNA, 312 bp, Homo sapiens
cccaaggccaaccccacggtcactctgttcccgccctcctctgaggagctccaagccaacaaggccacactagtgtgtctgatcagtgacttctacccgggagctgtgacagtggcttggaaggcagatggcagccccgtcaaggcgggagtggagacgaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 558 - protein, 104 aa, Homo sapiens
PKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 559 - DNA, 318 bp, Homo sapiens
ggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 560 - DNA, 318 bp, Homo sapiens; identical to SEQ ID NO: 559

SEQ ID NO: 561 - protein, 106 aa, Homo sapiens
GQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 562 - DNA, 318 bp, Homo sapiens
ggccagcctaaggccgctccttctgtgaccctgttccccccatcctccgaggaactgcaggctaacaaggccaccctcgtgtgcctgatcagcgacttctaccctggcgccgtgaccgtggcctggaaggctgatagctctcctgtgaaggccggcgtggaaaccaccaccccttccaagcagtccaacaacaaatacgccgcctcctcctacctgtccctgacccctgagcagtggaagtcccaccggtcctacagctgccaagtgacccacgagggctccaccgtggaaaagaccgtggctcctaccgagtgctcc

SEQ ID NO: 563 - DNA, 318 bp, Homo sapiens
ggccagcctaaagctgcccccagcgtcaccctgtttcctccctccagcgaggagctccaggccaacaaggccaccctcgtgtgcctgatctccgacttctatcccggcgctgtgaccgtggcttggaaagccgactccagccctgtcaaagccggcgtggagaccaccacaccctccaagcagtccaacaacaagtacgccgcctccagctatctctccctgacccctgagcagtggaagtcccaccggtcctactcctgtcaggtgacccacgagggctccaccgtggaaaagaccgtcgcccccaccgagtgctcc

SEQ ID NO: 564 - protein, 106 aa, Homo sapiens
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 565 - DNA, 318 bp, Homo sapiens
ggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 566 - DNA, 312 bp, Homo sapiens
cccaaggctgccccctcggtcactctgttcccaccctcctctgaggagcttcaagccaacaaggccacactggtgtgtctcataagtgacttctacccgggagccgtgacagttgcctggaaggcagatagcagccccgtcaaggcgggggtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagttgcccctacggaatgttca

SEQ ID NO: 567 - protein, 104 aa, Homo sapiens
PKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 568 - DNA, 318 bp, Homo sapiens
ggtcagcccaaggctgccccctcggtcactctgttcccaccctcctctgaggagcttcaagccaacaaggccacactggtgtgtctcataagtgacttctacccggggccagtgacagttgcctggaaggcagatagcagccccgtcaaggcgggggtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacggaatgttca

SEQ ID NO: 569 - protein, 106 aa, Homo sapiens
GQPKAAPSVTLFPPSSEELQANKATLVCLISDFYPGPVTVAWKADSSPVKAGVETTTPSKQSNNKYAASSYLSLTPEQWKSHKSYSCQVTHEGSTVEKTVAPTECS

SEQ ID NO: 570 - DNA, 318 bp, Homo sapiens
ggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 571 - protein, 106 aa, Homo sapiens
GQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 572 - DNA, 318 bp, Homo sapiens
ggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttca

SEQ ID NO: 573 - DNA, 318 bp, Homo sapiens
ggtcagcccaaggctgccccatcggtcactctgttcccgccctcctctgaggagcttcaagccaacaaggccacactggtgtgcctgatcagtgacttctacccgggagctgtgaaagtggcctggaaggcagatggcagccccgtcaacacgggagtggagaccaccacaccctccaaacagagcaacaacaagtacgcggccagcagctacctgagcctgacgcctgagcagtggaagtcccacagaagctacagctgccaggtcacgcatgaagggagcaccgtggagaagacagtggcccctgcagaatgttca

SEQ ID NO: 574 - protein, 106 aa, Homo sapiens
GQPKAAPSVTLFPPSSEELQANKATLVCLISDFYPGAVKVAWKADGSPVNTGVETTTPSKQSNNKYAASSYLSLTPEQWKSHRSYSCQVTHEGSTVEKTVAPAECS

SEQ ID NO: 575 - DNA, 318 bp, Homo sapiens
ggtcagcccaaggctgccccatcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 576 - protein, 106 aa, Homo sapiens
GQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 577 - DNA, 318 bp, Homo sapiens
ggtcagcccaaggctgccccctcggtcactctgttcccaccctcctctgaggagcttcaagccaacaaggccacactggtgtgtctcgtaagtgacttcaacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 578 - protein, 106 aa, Homo sapiens
GQPKAAPSVTLFPPSSEELQANKATLVCLVSDFNPGAVTVAWKADGSPVKVGVETTKPSKQSNNKYAASSYLSLTPEQWKSHRSYSCRVTHEGSTVEKTVAPAECS

SEQ ID NO: 579 - DNA, 978 bp, Homo sapiens
gcttctaccaagggacccagcgtgttccctctggctccttgctccagatccacctccgagtctacagctgctctgggctgcctggtcaaggactactttcctgagcctgtgaccgtgtcttggaactctggcgctctgacatctggcgtgcacacattccctgctgtgctgcagtcctccggcctgtactctctgtcctctgtcgtgaccgtgccttcctctagcctgggcaccaagacctacacctgtaatgtggaccacaagccttccaacaccaaggtggacaagcgcgtggaatctaagtacggccctccttgtcctccatgtcctgctccagagtttgaaggcggcccttccgtgtttctgttccctccaaagcctaaggacaccctgatgatctctcggacccctgaagtgacctgcgtggtggtggatgtgtcccaagaggatcccgaggtgcagttcaattggtacgtggacggcgtggaagtgcacaacgccaagaccaagcctagagaggaacagttcaactccacctacagagtggtgtccgtgctgaccgtgctgcaccaggattggctgaacggcaaagagtacaagtgcaaggtgtccaacaagggcctgcctagctccatcgaaaagaccatctccaaggccaagggccagcctcgagaaccccaggtttacaccctgcctccaagccaagaggaaatgaccaagaaccaggtgtccctgacctgcctcgtgaagggattctacccctccgatatcgccgtggaatgggagtctaatggccagccagagaacaactacaagacaacccctcctgtgctggactccgacggctccttctttctgtattcccgcctgaccgtggacaagtccagatggcaagagggcaacgtgttctcctgcagcgtgatgcacgaggccctgcacaatcactacacccagaagtccctgtctctgtccctgggc

SEQ ID NO: 580 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

What is claimed is:

1. A binder polypeptide that binds human matriptase-2 (MTP-2), comprising
  (a) a variable heavy (VH) domain comprising heavy chain complementarity determining regions (HCDRs) HCDR1, HCDR2 and HCDR3, wherein HCDR1 comprises an amino acid sequence of SEQ ID NO: 48, HCDR2 comprises an amino acid sequence of SEQ ID NO: 49, and HCDR3 comprises an amino acid sequence of SEQ ID NO: 50, and
  (b) a variable light (VL) domain comprising light chain complementarity determining regions (LCDRs) LCDR1, LCDR2 and LCDR3, wherein LCDR1 comprises an amino acid sequence of SEQ ID NO: 58, LCDR2 comprises an amino acid sequence of SEQ ID NO: 59, and LCDR3 comprises an amino acid sequence of SEQ ID NO: 60.

2. The binder polypeptide according to claim 1, wherein
  (a) HCDR1 consists of the amino acid sequence of SEQ ID NO: 48, HCDR2 consists of the amino acid sequence of SEQ ID NO: 49, and HCDR3 consists of the amino acid sequence of SEQ ID NO: 50, and
  (b) LCDR1 consists of the amino acid sequence of SEQ ID NO: 58, LCDR2 consists of the amino acid sequence of SEQ ID NO: 59, and LCDR3 consists of the amino acid sequence of SEQ ID NO: 60.

3. The binder polypeptide according to claim 1, wherein
  (a) the VH domain comprises an amino acid sequence having at least 90% identity to SEQ ID NO: 67, and
  (b) the VL domain comprises an amino acid sequence having at least 90% identity to SEQ ID NO: 63.

4. The binder polypeptide according to claim 3, wherein
  (a) the VH domain comprises the amino acid sequence of SEQ ID NO: 67, and
  (b) the VL domain comprises the amino acid sequence of SEQ ID NO: 63.

5. The binder polypeptide according to claim 4, wherein
  (a) the VH domain consists of an amino acid sequence of SEQ ID NO: 67, and
  (b) the VL domain consists of an amino acid sequence of SEQ ID NO: 63.

6. The binder polypeptide according to claim 1, wherein the binder polypeptide comprises an antibody constant region.

7. The binder polypeptide according to claim 6, wherein the antibody constant region comprises a YTE mutation.

8. The binder polypeptide according to claim 6, wherein the antibody constant region is derived from an IgG isotype.

9. The binder polypeptide according to claim 8, wherein the antibody constant region comprises a human IgG4PE antibody constant region.

10. The binder polypeptide according to claim 1, comprising
  (a) a heavy chain comprising an amino acid sequence of SEQ ID NO: 69, and
  (b) a light chain comprising an amino acid sequence of SEQ ID NO: 65.

11. The binder polypeptide according to claim 10, comprising
  (a) a heavy chain consisting of the amino acid sequence of SEQ ID NO: 69, and
  (b) a light chain consisting of the amino acid sequence of SEQ ID NO: 65.

12. A nucleic acid encoding a binder polypeptide according to claim 1.

13. A host cell in vitro comprising the nucleic acid according to claim 12.

14. A pharmaceutical composition comprising a binder polypeptide according to claim 1, and a pharmaceutically acceptable excipient.

15. A method of reducing absorption of dietary iron in a patient, the method comprising administering to the patient the pharmaceutical composition according to claim 14.

16. The method according to claim 15, wherein the patient has beta-thalassaemia, myelodysplastic syndrome with chromosomal deletion of 5q-(5q-MDS), or refractory anaemia with ring-sideroblasts (RARS).

17. A method of treating iron overload in a patient, the method comprising administering to the patient the pharmaceutical composition according to claim 14.

18. The method according to claim 17, wherein the patient has beta-thalassaemia, myelodysplastic syndrome with chromosomal deletion of 5q-(5q-MDS), or refractory anaemia with ring-sideroblasts (RARS).

19. A method of elevating expression of hepcidin from hepatocytes in a patient, the method comprising administering to the patient the pharmaceutical composition according to claim 14.

20. The method according to claim 19, wherein the patient has beta-thalassaemia, myelodysplastic syndrome with chromosomal deletion of 5q-(5q-MDS), or refractory anaemia with ring-sideroblasts (RARS).

21. A method of decreasing serum iron concentration in a patient, the method comprising administering to the patient the pharmaceutical composition according to claim 14.

22. The method according to claim 21, wherein the patient has beta-thalassaemia, myelodysplastic syndrome with chromosomal deletion of 5q-(5q-MDS), or refractory anaemia with ring-sideroblasts (RARS).

* * * * *